US011286527B2

(12) United States Patent
Mikko et al.

(10) Patent No.: US 11,286,527 B2
(45) Date of Patent: Mar. 29, 2022

(54) DIAGNOSTIC TEST FOR SKELETAL ATAVISM IN HORSES

(71) Applicants: Sofia Mikko, Knivsta (SE); Leif Andersson, Uppsala (SE); Gabriella Lindgren, Knivsta (SE); Carl-Johan Rubin, Uppsala (SE); Bhanu Chowdhary, College Station, TX (US); Terje Raudsepp, College Station, TX (US); Evan E. Eichler, Seattle, WA (US); John Huddleston, Seattle, WA (US); Maika Malig, Seattle, WA (US)

(72) Inventors: Sofia Mikko, Knivsta (SE); Leif Andersson, Uppsala (SE); Gabriella Lindgren, Knivsta (SE); Carl-Johan Rubin, Uppsala (SE); Bhanu Chowdhary, College Station, TX (US); Terje Raudsepp, College Station, TX (US); Evan E. Eichler, Seattle, WA (US); John Huddleston, Seattle, WA (US); Maika Malig, Seattle, WA (US)

(73) Assignees: CAPILET GENETICS AB, Vasteras (SE); UNIVERSITY OF WASHINGTON, Seattle, WA (US)

( * ) Notice: Subject to any disclaimer, the term of this patent is extended or adjusted under 35 U.S.C. 154(b) by 0 days.

(21) Appl. No.: 16/004,537

(22) Filed: Jun. 11, 2018

(65) Prior Publication Data

US 2018/0282812 A1 Oct. 4, 2018

Related U.S. Application Data

(63) Continuation of application No. 14/888,994, filed as application No. PCT/US2014/036746 on May 5, 2014, now abandoned.

(30) Foreign Application Priority Data

May 6, 2013 (SE) .................................. 1330047-0

(51) Int. Cl.
*C07H 21/04* (2006.01)
*C12Q 1/68* (2018.01)
*A01K 67/00* (2006.01)
*C12Q 1/6883* (2018.01)

(52) U.S. Cl.
CPC ..... *C12Q 1/6883* (2013.01); *C12Q 2600/156* (2013.01)

(58) Field of Classification Search
None
See application file for complete search history.

(56) References Cited

U.S. PATENT DOCUMENTS 7,208,274 B2   4/2007  Dhallon
2003/0059805 A1 3/2003  Rappold

OTHER PUBLICATIONS

Lear et al. (Sex Dev. vol. 6, pp. 61-71, Nov. 17, 2011). (Year: 2011).*
Raudsepp et al. (Cytogeneti Genome Res, vol. 121, No. 2, pp. 102-109, 2008.*
Tyson, "Skeletal Atavism in a minature horse," Veterinary Radiology & Ultrasound, Jul. 1, 2004, vol. 45, pp. 315-317.
Shears, "Mutation and detection of the pseudoautosomal gene SHOX cause Leri-Weill dyschodrosteosis," Nature Genetics, May 1, 1998, vol. 19, pp. 7-73.
Leka, "Short stature and sysmorphology associated with defects in the SHOX gene," Homones, Apr. 1, 2006, vol. 5, pp. 107-118.
International Search Report issued in PCT/US2014/036746, dated Sep. 20, 2014, pp. 1-3.
Written Opinion issued in PCT/US2014/036746, dated Sep. 30, 2014, pp. 1-10.
Extended European Search Report issued in EP application No. 14794101.7, dated Dec. 12, 2016, pp. 1-8.
Sara Benito-Sanz, "A Novel class of pseudoautosomal region 1 deletions downstream of SHOX is associated with Leri-Weill Dyschondrosteosis," The American Journal of Human Genetic, Jan. 1, 2005, pp. 533-544.
Flanagan, "Prevelance of mutations in the short stature homeobox containing gene SHOX in madelung deformity of childhood," Journal of Medical Genetics, vol. 39, No. 10, Oct. 1, 2002, pp. 758-763.
Blaschke, "The pseudoautosomal regions, SHOX and disease," Current Opinion in Genetics & Development, Current Biology Ltd., XX, vol. 16, No. 3, Jun. 1, 2006, pp. 233-239.
Beate, "The human SHOX mutation database," Human Mutation, vol. 20, No. 5, Nov. 25, 2002, pp. 338-341.
Lear et al. (Sex Dev. vol. 6, pp. 61-71, Nov. 17, 2011).
Raudsepp et al. (Cytogenet. Genome Res. vol. 121, pp. 102-109, 2008).
Speed, "A cause of malformation of the limbs of shetland ponies with a note on its phylogenic significance," The British Veterinary Journal, 1958:18-22.
Hermans, "A hereditary anomaly in shetland ponies," Neth J. vet. Sci. 1970, 3(1): 55-63.
Shamis, "Complete ulnas and fibulas in a pony foal," J. Am. Vet. Med Assoc. 1985, 186:802-804.
Tyson, "Skeletal atavism in a minature horse," Vet. Radiol Ultrasound 2004, 45:315-317.

(Continued)

*Primary Examiner* — Jeanine A Goldberg
(74) *Attorney, Agent, or Firm* — Jeffrey S. Melcher; Melcher Patent Law PLLC

(57) ABSTRACT

The present invention relates to methods for detecting a genetic deletion at the SHOX locus of a horse, where the presence of such a genetic deletion indicates that the horse is a carrier of disease-causing mutation that can lead to skeletal atavism. The invention further provides nucleic acid primers and probes for use in methods for detecting the presence or absence of disease-causing genetic deletion at the SHOX locus of a horse.

3 Claims, 1 Drawing Sheet

Specification includes a Sequence Listing.

(56) References Cited

OTHER PUBLICATIONS

Wade, "Genome sequence, comparative analysis, and population genetics of the domestic horse," Science 2009, 326:865-867.
Durbin, "Fast and accurate short read alignment with Burrows-Wheeler trasform," Bioninformantics 2009, 25:1754-1760.
Handsaker, "The sequence alignment/map format and SAMtools," Bionformantics 2009, 25:2078-2079.
McKenna, "The genome analysis tookit: a MapReduce framework for analyzing next-generation DNA sequencing data," Genome Res 2010, 20:1297-1303.
Blashke, "The pseudoautosomal regions, SHOX and disease," Curr Opin. Genet. Dev 2006, 16:233-239.
Rosilio, "Genotypes and phenotypes of children with SHOX deficiency in France," J. Clin Endocrinol Metab 2012, 97:E1275-1265.

\* cited by examiner

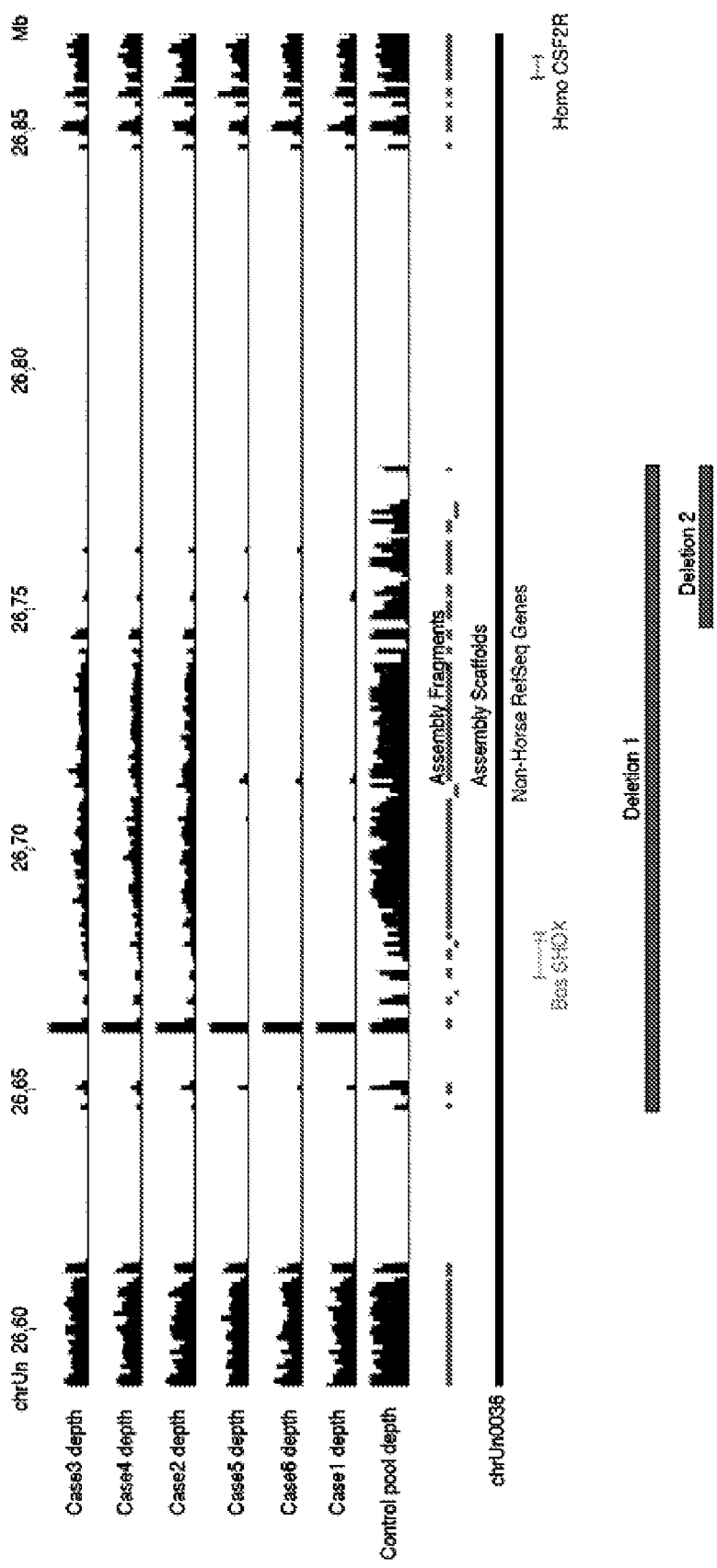

DIAGNOSTIC TEST FOR SKELETAL ATAVISM IN HORSES

FIELD OF THE INVENTION

The present invention relates to methods and nucleic acid fragments for detecting a genetic deletion at the SHOX locus of a horse, where the presence of such a genetic deletion indicates that the horse is a carrier of disease-causing mutation that can lead to skeletal atavism.

BACKGROUND OF THE INVENTION

Speed [1] and Hermans [2] published the first scientific reports on fully developed ulna and fibula in horses, and they both described this defect in the Shetland pony breed. Speed described this anatomic variation as a type of atavism in certain families of Shetland pony foals in the United Kingdom. The affected foals had complete ulnas and fibulas with associated angular limb deformities and developed progressive interrupted movements and lameness. The recurrence in certain families suggested a hereditary basis for the anomaly. Speed described that the parents were phenotypically normal and the anomaly was noted to skip generations. Hermans (1970) reported that fifty Shetland ponies with atavism were recorded in Utrecht from year 1961 to 1967. Hermans performed test matings to elucidate the inheritance pattern of the defect and the results suggested that skeletal atavism in Shetland ponies follow an autosomal recessive mode of inheritance.
In addition to Shetland ponies rare occurrences of the defect have been described in Welsh pony [3] and in Miniature horse [4].

There is a strong need in the horse breeding industry to develop a diagnostic test to identify animals that are carriers of the recessive allele causing skeletal atavism so that such carriers can be eliminated from the breeding population which means that the disorder will be eradicated.

DESCRIPTION OF THE INVENTION

The present inventors have identified mutations that can lead to skeletal atavism in the horse. The mutations are demonstrated to be two different deletion alleles, D1 and D2, associated with the Short Stature Homeobox (SHOX) locus.

Accordingly, the present invention provides methods for detecting disease-causing genetic deletions at the SHOX locus of a horse, where the presence of such a genetic deletion indicates that the horse is a carrier of a mutation that can lead to skeletal atavism.

Put another way, the present invention provides methods for determining if a horse is a carrier of a mutation that can lead to skeletal atavism. The method can comprise the steps,
  i) extracting DNA from a sample obtained from a horse,
  ii) determining in said DNA the presence of a genetic deletion at the SHOX locus,
  where the presence of said genetic deletion indicates that the horse is a carrier of a mutation that can lead to skeletal atavism.

The genetic deletion can be the D1 and/or the D2 deletion according to the present invention. The horse carrying a disease-causing mutation can be heterozygous for the D1 allele, the D2 allele, or both the D1 and D2 alleles, or homozygous for the D1 allele or the D2 allele.

The D1 allele is the allele with the D1 genetic deletion, the D2 allele is the allele with the D2 deletion.

In one aspect, the present invention provides methods for detecting the presence of a nucleic acid sequence in the genome of a horse, said nucleic acid sequence being a part of the D1 deletion. Preferably, the nucleic acid sequence to be detected can be selected from a nucleic acid sequence present in the nucleic acid sequences SEQ ID NOs: 10 to 117.

The presence of one copy only of said nucleic acid in the genome of said horse, being indicative of said horse being heterozygous for the D1 deletion, and hence a carrier of a disease-causing mutation than can lead to skeletal atavism. The absence of said nucleic acid in the genome of said horse, being indicative of said horse being homozygous for the D1 deletion, and hence a carrier of a disease-causing mutation that can lead to skeletal atavism.

The D1 deletion according to the invention comprises the contigs indicated in Table 2 of the horse reference genome assembly EquCab2 corresponding to SEQ ID NOs: 10 to 110.

The D1 deletion according to the invention comprises the nucleic acid sequences present in the BAC derived contigs indicated in Table 5 corresponding to SEQ ID NOs: 111 to 117.

In another aspect, the present invention provides methods for detecting the presence of a nucleic acid sequence in the genome of a horse, said nucleic acid sequence being a part of the D2 deletion. Preferably, the nucleic acid sequence to be detected can be selected from a nucleic acid sequence present in the nucleic acid sequences SEQ ID NOs: 10 to 58, 91 to 95, 97 to 110, and 115 to 117.

The presence of one copy only of said nucleic acid in the genome of said horse, being indicative of said horse being heterozygous for the D2 deletion, and hence a carrier of a disease-causing mutation that can lead to skeletal atavism. The absence of said nucleic acid in the genome of said horse, being indicative of said horse being homozygous for the D2 deletion, and hence a carrier of a disease-causing mutation that can lead to skeletal atavism.

The D2 deletion according to the invention comprises the nucleic acid sequences present in the contigs indicated in Table 2 of the horse reference genome assembly EquCab2 corresponding to SEQ ID NOs: 10 to 58, 91 to 95, and 97 to 110.

The D2 deletion according to the invention comprises the nucleic acid sequences present in the BAC derived contigs indicated in Table 5 corresponding to SEQ ID NOs: 115 to 117.

The term "SHOX locus" is intended to include all DNA sequences of the BAC derived contigs of the horse genome listed in Table 5, i.e. the DNA sequences corresponding to SEQ NOs:111 to 117, and any intervening DNA sequences, including 100 kB upstream and downstream of the SHOX gene.

"Sketetal Atavism" refers to the disorder involving ulna and fibula development in the horse, as the condition to some extent mimics the skeletal development present in ancestors of horses with full development of the ulna and tibia.

According to one aspect of the invention the methods according to the present invention can be used for selecting horses for breeding.

According to one aspect of the invention the methods according to the present invention can be used for parental testing of horses.

Preferably, the methods according to the invention comprise extraction of DNA from a biological sample obtained from a horse.

The term "sample" or "biological sample" according to the present invention refers to any material containing nucleated cells from said horse to be tested. In a preferred embodiment the biological sample to be used in the methods of the present invention is selected from the group consisting of blood, sperm, hair roots, milk, body fluids as well as tissues including nucleated cells.

DNA extraction, isolation and purification methods are well-known in the art and can be applied in the present invention. Standard protocols for the isolation of genomic DNA are inter alia referred to in Sambrook, J., Russell. D. W. Molecular Cloning: A Laboratory Manual, the third edition, Cold Spring Harbor Laboratory Press, Cold Spring Harbor. New York, 1.31-1.38, 2001 and Sharma. R. C., et al. "A rapid procedure for isolation of RNA-free genomic DNA from mammalian cells", BioTechniques, 14. 176-178, 1993.

There are several methods known by those skilled in the art for determining whether a particular nucleotide sequence is present in a DNA sample and for identifying the nucleotide in a specific position in a DNA sequence. These include the amplification of a DNA segment encompassing the genetic marker by means of the polymerase chain reaction (PCR) or any other amplification method, interrogate the genetic marker by means of allele specific hybridization, the 3'exonuclease assay (Taqman assay), fluorescent dye and quenching agent-based PCR assay, the use of allele-specific restriction enzymes (RFLP-based techniques), direct sequencing, the oligonucleotide ligation assay (OLA), pyrosequencing, the invader assay, minisequencing, DHPLC-based techniques, single strand conformational polymorphism (SSCP), allele-specific PCR, denaturating gradient gel electrophoresis (DGGE), temperature gradient gel electrophoresis (TGGE), chemical mismatch cleavage (CMC), heteroduplex analysis based system, techniques based on mass spectroscopy, invasive cleavage assay, polymorphism ratio sequencing (YRS), microarrays, a rolling circle extension assay, HPLC-based techniques, extension based assays, ARMS (Amplification Refractory Mutation System), ALEX (Amplification Refractory Mutation Linear Extension), SBCE (Single base chain extension), molecular beacon assays, invader (Third wave technologies), ligase chain reaction assays, 5'-nuclease assay-based techniques, hybridization capillary array electrophoresis (CAE), single molecule sequencing such as nanopore sequencing, protein truncation assays (PTT), immunoassays, and solid phase hybridization (dot blot, reverse dot blot, chips). This list of methods is not meant to be exclusive, but just to illustrate the diversity of available methods. Some of these methods can be performed in accordance with the methods of the present invention in microarray format (microchips) or on beads.

The invention thus also relates to primers, primer pairs or probes, hybridizing under stringent conditions to a nucleic acid sequence present in or flanking the deleted regions D1 and D2 according to the invention, or to the complementary strand thereof, and their use in the methods according to the invention. By a nucleic acid sequence flanking the deleted regions D1 and D2 is meant nucleic acid sequences 10 kB upstream or downstream of D1 or D2, such as 1 kB, or 100 bases upstream or downstream of D1 or D2.

Primers hybridizing to these flanking regions are particularly useful for PCR amplification in the methods according to the invention. Use of one primer hybridizing to a nucleic acid sequence in D1 and one primer hybridizing to a nucleic acid sequence flanking the D1 will only lead to amplification when D1 is present. Use of one primer hybridizing to a nucleic acid sequence in D2 and one primer hybridizing to a nucleic acid sequence flanking the D2 will only lead to amplification when D2 is present. Use of one primer hybridizing to a nucleic acid sequence flanking D1 upstream and one primer hybridizing to a nucleic acid sequence flanking D1 downstream will only lead to amplification when D1 is absent. Use of one primer hybridizing to a nucleic acid sequence flanking D2 upstream and one primer hybridizing to a nucleic acid sequence flanking D2 downstream will only lead to amplification when D2 is absent.

Primers hybridizing to nucleic acid sequences introduced by a mutational event leading to and creating D1 and/or D2 are particularly useful for PCR amplification in the methods according to the invention.

Preferably the primers or primer pairs hybridize(s) under stringent conditions to the sequences SEQ ID NOs: 10 to 110, or to the complementary strand thereof.

Preferably, the primers of the invention have a length of at least 14 nucleotides such as 17 or 21 nucleotides.

More specifically the primers can be selected from SEQ NO:1, SEQ ID NO:2, SEQ ID NO:3, SEQ ID NO:4, SEQ ID NO:5, and SEQ ID NO:6.

Hybridization is preferably performed under stringent or highly stringent conditions. "Stringent or highly stringent conditions" of hybridization are well known to or can be established by the person skilled in the art according to conventional protocols. Appropriate stringent conditions for each sequence may be established on the basis of well-known parameters such as temperature, composition of the nucleic acid molecules, salt conditions etc.: see, for example, Sambrook et al. "Molecular Cloning, A Laboratory Manual", CSH Press, Cold Spring Harbor, 1989 or Higgins and Hames (eds.), "Nucleic acid hybridization, a practical approach", IRL Press, Oxford 1985, see in particular the chapter "Hybridization Strategy" by Britten & Davidson. Typical (highly stringent) conditions comprise hybridization at 65° C. in 0.5×SSC and 0.1% SDS or hybridization at 42° C. in 50% formamide, 4×SSC and 0.1% SDS. Hybridization is usually followed by washing to remove unspecific signals. Washing conditions include conditions such as 65° C., 0.2×SSC and 0.1% SDS or 2×SSC and 0.1% SDS or 0.3×SSC and 0.1% SDS at 25° C.-65° C.

LEGEND TO FIGURES

FIG. 1: Depth of sequence read coverage observed in whole genome resequencing. Shown is the depth at the SHOX locus for six Skeletal Atavism cases (CG1-6) and for the pool of healthy control stallions. Boxes have been inserted to visualize approximate locations of the two deletions in the EquCab2 assembly context.

EXAMPLES

Methods
Illumina Sequencing and Sequence Analysis

DNA samples from six Shetland ponies diagnosed by veterinarians with Skeletal Atavism (SA), individuals CG1, CG2, CG3, CG4, CG5 and CG6, as well as a control pool consisting of equimolar amounts of DNA from 22 stallions (who had never fathered Atavistic foals despite having fathered many foals) were prepared for sequencing. Illumina paired-end libraries were generated from these DNA samples with mean insert sizes of approximately 220 bp. The two libraries were sequenced using an Illumina HiSeq instrument as paired-end reads (2×100 bp). The reads were mapped to the horse reference genome assembly [5] using the software BWA [6], and PCR-duplicates were removed using the software Picard (http://picard.sourceforge.net). The average read depth obtained was approximately 7× for each SA individual and approximately 55× average depth for the control pool. SNPs and small insertions/deletions were called from the mapping data after subjecting the alignments to realignment around indels and then variant calling using the Genome Analysis Toolkit (GATK) [8]. The variant calls were subjected to recommended VariantFiltrationWalker filters for SNPs listed in the GATK wiki page (http://www.broadinstitute.org/gsa/wiki/index.php/The_Genome_Analysis_Toolkit).

The software SAMtools [7] was used to determine sequence read depths observed in windows of one kilobase over the whole genome and candidate deletions and duplications were called using these depths. Furthermore the paired read mapping distances as well as strands were used to detect structural variations in relation to the reference assembly and in relation to the control pool.

Digital Droplet PCR (ddPCR)

The ddPCR reaction mixtures consisted of 11 µl 2×ddPCR Supermix for probes (Bio-Rad), 1.1 µl of the primer/probe mix for one of the deletion assays and 1.1 ul of the RNAsc P reference gene primer/probe mix (900 nM final concentration of each primer, 250 nM of probe) and 1 µl of sample DNA (concentration 20 ng/µl) in a final volume of 22 µl (see Table 1 for primer and probe sequences). 20 µl of reaction mixture was loaded into a disposable plastic cartridge (DG8, Bio-Rad) together with 70 µl of droplet generation oil (DG oil, Bio-Rad) and placed in the QX100 droplet generator (Bio-Rad). The droplets generated from each sample were then transferred to a 96-well Twin Tec semi-skirted PCR plate (Eppendorf, Germany) which was heat-sealed with Easy Pierce Foil (Thermo).

TABLE 1

Sequences of primers and probes used in digital droplet PCR to genotype deletions at the Equine SHOX locus

| Name | Target | Type | Sequence* | SEQ ID NO | 5'-modification | 3'-modification |
|---|---|---|---|---|---|---|
| EqD1_F | Deletion 1 | primer | TCCCCGRGTGTGGAAAGTTA | 1 | None | None |
| EqD1_R | Deletion 1 | primer | CCACAAAGCACATCCGTTTA | 2 | None | None |
| EqD1_probe | Deletion 1 | probe | ACGGGAAGGAGGGGGCCC | 3 | FAM | MGB |
| EqD2_F | Deletion 2 | primer | CCMGCTTTTGTCCCTTAAAC | 4 | None | None |
| EqD2_R | Deletion 2 | primer | TCCAGGCGATTTCCAACTAA | 5 | None | None |
| EqD2_probe | Deletion 2 | probe | CCAGCTCTGGGCTCGGCTCC | 6 | FAM | MGB |
| Eq_RNAseP_F | RNAse P | primer | GTTCCAAGCTCCGGCTAAG | 7 | None | None |
| Eq_RNAseP_R | RNAse P | primer | GGAGGTGGGTTCCCAGAG | 8 | None | None |
| Eq_RNAseP_probe | RNAse P | probe | TCTGCCCTCGCGCGGAGC | 9 | VIC | MGB |

*Non-standard bases correspond to nucleic acid ambiguity codes and indicate positions where mixed bases have been incorporated in primers PCR amplification was carried out on a T1000 Touch thermal cycler (Bio-Rad) using a thermal profile beginning at 95° C. for 10 min, followed by 40 cycles of 94° C. for 30 s and 60° C. for 60 s, 1 cycle of 98° C. for 10 min, and ending at 4° C. After amplification, the plate was loaded on the droplet reader (Bio-Rad) and the droplets from each well of the plate were read automatically. ddPCR data were analyzed using the QuantaSoft analysis software (Bio-Rad).

Identification of the Mutations Causing Skeletal Atavism

To identify the mutation(s) causing skeletal atavism in Shetland ponnies whole genome resequencing of affected horses and controls were performed. DNA samples from six individual Swedish Shetland ponies diagnosed with skeletal atavism, and a pool of 22 unaffected control stallions were sequenced using Illumina Hi-seq technology with resulting average sequence depths of 7× (each affected individual) and 55× (control pool). After aligning the reads to the reference genome assembly EquCab2 [5] (http://www.ncbi.nlm.nih.gov/assembly/GCA_000002305.1/) using the software BWA [6]. SAMtools [7] was used to determine genome wide depth of coverage for each sequenced sample and GATK [8] to call polymorphisms and to determine genotypes in the samples and to estimate the allele frequencies in the pool.

Next single nucleotide polymorphisms (SNPs) were screened for where each affected horse was homozygous for the variant allele and where the reference allele frequency was 100% in the control pool. In total, 25 SNPs fulfilled this criterion, and 17 of these were located to a very fragmented unplaced scaffold that contains the short stature homeobox (SHOX) gene.

An analysis of the depth of sequence read coverage revealed two separate partially overlapping deletions estimated to be at least 116 Kb and 34 Kb, respectively (FIG. 1) and involved the genome assembly contigs listed in Table 2.

TABLE 2

Horse sequence contigs predicted to be part of the two identified deletions based on depth of sequence coverage from the six cases and the control pool

| ^ Scaffold accession | ^ Contig accession | * Predicted to be part of deletion(s) | SEQ ID NO |
|---|---|---|---|
| NW_001867655.1 | AAWR02042945.1 | D1 AND D2 | 10 |
| NW_001867655.1 | AAWR02042946.1 | D1 AND D2 | 11 |
| NW_001867655.1 | AAWR02042947.1 | D1 AND D2 | 12 |
| NW_001867655.1 | AAWR02042948.1 | D1 AND D2 | 13 |
| NW_001867655.1 | AAWR02042949.1 | D1 AND D2 | 14 |
| NW_001867655.1 | AAWR02042950.1 | D1 AND D2 | 15 |
| NW_001867655.1 | AAWR02042951.1 | D1 AND D2 | 16 |
| NW_001867655.1 | AAWR02042952.1 | D1 AND D2 | 17 |
| NW_001867655.1 | AAWR02042953.1 | D1 AND D2 | 18 |
| NW_001867655.1 | AAWR02042954.1 | D1 AND D2 | 19 |
| NW_001867655.1 | AAWR02042955.1 | D1 AND D2 | 20 |
| NW_001867655.1 | AAWR02042956.1 | D1 AND D2 | 21 |
| NW_001867655.1 | AAWR02042957.1 | D1 AND D2 | 22 |
| NW_001867655.1 | AAWR02042958.1 | D1 AND D2 | 23 |
| NW_001867655.1 | AAWR02042959.1 | D1 AND D2 | 24 |
| NW_001867655.1 | AAWR02042960.1 | D1 AND D2 | 25 |
| NW_001867655.1 | AAWR02042961.1 | D1 AND D2 | 26 |
| NW_001867655.1 | AAWR02042962.1 | D1 AND D2 | 27 |
| NW_001867655.1 | AAWR02042963.1 | D1 AND D2 | 28 |
| NW_001867655.1 | AAWR02042964.1 | D1 AND D2 | 29 |
| NW_001867655.1 | AAWR02042965.1 | D1 AND D2 | 30 |
| NW_001867655.1 | AAWR02042966.1 | D1 AND D2 | 31 |
| NW_001867655.1 | AAWR02042967.1 | D1 AND D2 | 32 |
| NW_001867655.1 | AAWR02042968.1 | D1 AND D2 | 33 |
| NW_001867655.1 | AAWR02042969.1 | D1 AND D2 | 34 |
| NW_001867655.1 | AAWR02042970.1 | D1 AND D2 | 35 |
| NW_001867655.1 | AAWR02042971.1 | D1 AND D2 | 36 |
| NW_001867655.1 | AAWR02042972.1 | D1 AND D2 | 37 |
| NW_001867655.1 | AAWR02042973.1 | D1 AND D2 | 38 |
| NW_001867655.1 | AAWR02042974.1 | D1 AND D2 | 39 |
| NW_001867655.1 | AAWR02042975.1 | D1 AND D2 | 40 |
| NW_001867655.1 | AAWR02042976.1 | D1 AND D2 | 41 |
| NW_001867655.1 | AAWR02042977.1 | D1 AND D2 | 42 |
| NW_001867655.1 | AAWR02042978.1 | D1 AND D2 | 43 |
| NW_001867655.1 | AAWR02042979.1 | D1 AND D2 | 44 |
| NW_001867655.1 | AAWR02042980.1 | D1 AND D2 | 45 |
| NW_001867655.1 | AAWR02042981.1 | D1 AND D2 | 46 |
| NW_001867655.1 | AAWR02042982.1 | D1 AND D2 | 47 |
| NW_001867655.1 | AAWR02042983.1 | D1 AND D2 | 48 |
| NW_001867655.1 | AAWR02042984.1 | D1 AND D2 | 49 |
| NW_001867655.1 | AAWR02042985.1 | D1 AND D2 | 50 |
| NW_001867655.1 | AAWR02042986.1 | D1 AND D2 | 51 |
| NW_001867655.1 | AAWR02042987.1 | D1 AND D2 | 52 |
| NW_001867655.1 | AAWR02042988.1 | D1 AND D2 | 53 |
| NW_001867655.1 | AAWR02042989.1 | D1 AND D2 | 54 |
| NW_001867655.1 | AAWR02042990.1 | D1 AND D2 | 55 |
| NW_001867655.1 | AAWR02042991.1 | D1 AND D2 | 56 |
| NW_001867655.1 | AAWR02042992.1 | D1 AND D2 | 57 |
| NW_001867655.1 | AAWR02042993.1 | D1 AND D2 | 58 |
| NW_001867809.1 | AAWR02043090.1 | D1 | 59 |
| NW_001867809.1 | AAWR02043091.1 | D1 | 60 |
| NW_001867809.1 | AAWR02043092.1 | D1 | 61 |
| NW_001867809.1 | AAWR02043093.1 | D1 | 62 |
| NW_001867809.1 | AAWR02043094.1 | D1 | 63 |
| NW_001867809.1 | AAWR02043095.1 | D1 | 64 |
| NW_001867809.1 | AAWR02043096.1 | D1 | 65 |
| NW_001867809.1 | AAWR02043097.1 | D1 | 66 |
| NW_001867809.1 | AAWR02043098.1 | D1 | 67 |
| NW_001867809.1 | AAWR02043099.1 | D1 | 68 |
| NW_001867809.1 | AAWR02043100.1 | D1 | 69 |
| NW_001867809.1 | AAWR02043101.1 | D1 | 70 |
| NW_001867809.1 | AAWR02043102.1 | D1 | 71 |
| NW_001867809.1 | AAWR02043103.1 | D1 | 72 |
| NW_001867809.1 | AAWR02043104.1 | D1 | 73 |
| NW_001869437.1 | AAWR02043982.1 | D1 | 74 |
| NW_001869437.1 | AAWR02043983.1 | D1 | 75 |
| NW_001869437.1 | AAWR02043984.1 | D1 | 76 |
| NW_001869437.1 | AAWR02043985.1 | D1 | 77 |
| NW_001869437.1 | AAWR02043986.1 | D1 | 78 |
| NW_001869437.1 | AAWR02043987.1 | D1 | 79 |
| NW_001870009.1 | AAWR02044192.1 | D1 | 80 |
| NW_001870009.1 | AAWR02044193.1 | D1 | 81 |
| NW_001870009.1 | AAWR02044194.1 | D1 | 82 |
| NW_001870009.1 | AAWR02044195.1 | D1 | 83 |
| NW_001870009.1 | AAWR02044196.1 | D1 | 84 |
| NW_001870009.1 | AAWR02044197.1 | D1 | 85 |
| NW_001873507.1 | AAWR02044981.1 | D1 | 86 |
| NW_001873507.1 | AAWR02044982.1 | D1 | 87 |
| NW_001873507.1 | AAWR02044983.1 | D1 | 88 |
| NW_001875146.1 | AAWR02045249.1 | D1 | 89 |
| NW_001875146.1 | AAWR02045250.1 | D1 | 90 |
| NW_001876884.1 | AAWR02045517.1 | D1 AND D2 | 91 |
| NW_001876884.1 | AAWR02045518.1 | D1 AND D2 | 92 |
| NW_001876884.1 | AAWR02045519.1 | D1 AND D2 | 93 |
| NW_001876884.1 | AAWR02045520.1 | D1 AND D2 | 94 |
| NW_001876884.1 | AAWR02045521.1 | D1 AND D2 | 95 |
| NW_001871185.1 | AAWR02049699.1 | D1 | 96 |
| NW_001869338.1 | AAWR02043946.1 | D1 AND D2 | 97 |
| NW_001869338.1 | AAWR02043947.1 | D1 AND D2 | 98 |
| NW_001869338.1 | AAWR02043948.1 | D1 AND D2 | 99 |
| NW_001869338.1 | AAWR02043949.1 | D1 AND D2 | 100 |
| NW_001869338.1 | AAWR02043950.1 | D1 AND D2 | 101 |
| NW_001869338.1 | AAWR02043951.1 | D1 AND D2 | 102 |
| NW_001869338.1 | AAWR02043952.1 | D1 AND D2 | 103 |
| NW_001869338.1 | AAWR02043953.1 | D1 AND D2 | 104 |
| NW_001867532.1 | AAWR02045716.1 | D1 AND D2 | 105 |
| NW_001867532.1 | AAWR02045717.1 | D1 AND D2 | 106 |
| NW_001867532.1 | AAWR02045718.1 | D1 AND D2 | 107 |
| NW_001867532.1 | AAWR02045719.1 | D1 AND D2 | 108 |
| NW_001873348.1 | AAWR02051849.1 | D1 AND D2 | 109 |
| NW_001873348.1 | AAWR02051850.1 | D1 AND D2 | 110 |

^ Scaffold and Contig accessions: Genbank accession numbers of the reference genome assembly contigs and Scaffolds.
* Deletion overlap: Presumed deletion(s) involving the contig.

It was not possible to determine the exact size of the two deletions with confidence using this approach due to the poor assembly of this region. The largest deletion (D1) spans over the entire coding sequence of SHOX while the other (D2) involves the region immediately downstream of the SHOX coding sequence (FIG. 1). SHOX has been mapped to the pseudo-autosomal region (PAR) of the X and Y-chromosomes in other mammals and it is very likely that it is located in the PAR region in horses as well. In humans, mutation and haploinsufficiency of SHOX are associated with idiopathic growth retardation [9,10].

Sequencing of Bacterial Artificial Chromosomes (BACs)

In order to obtain additional sequence information BACs whose ends (BAC-ends) had been previously sequenced as a part of the generation of the horse genome assembly (EquCab2) and that were predicted to reside in the Pseudo-autosomal region close to the SHOX gene were identified. 13 such BACs from the CHORI-241 BAC library (http://bacpac.chori.org/library.php?id=41) made from a Thoroughbred male horse (not carrying the deletions Del1 or Del2), available from the BACPAC resource at the Childrens Hospital Oakland Research Institute (http://bacpac.chori.or&equine241.htm) were identified.

TABLE 4

Sequenced BACs from SHOX region

| BAC | Size(bp) | #scaffolds | Min (bp) | Max (bp) |
|---|---|---|---|---|
| CH241-087.2_E10 | 154 201 | 1 | 154 201 | 154 201 |
| CH241-121_P22 | 218 546 | 1 | 218 546 | 218 546 |
| CH241-231_N3 | 191 296 | 1 | 191 296 | 191 296 |
| CH241-219B18 | 67 454 | 2 | 899 | 66 555 |

TABLE 4-continued

Sequenced BACs from SHOX region

| BAC | Size(bp) | #scaffolds | Min (bp) | Max (bp) |
|---|---|---|---|---|
| CH241-52P20 | 66 939 | 2 | 852 | 66 087 |
| CH241-288L23 | 186 195 | 7 | 886 | 57 130 |
| CH241-159K1 | 47 668 | 4 | 1 660 | 27 250 |
| CH241-050_P17 | 147 467 | 1 | 147 467 | 147 467 |
| CH241-194_E12 | 155 628 | 1 | 155 628 | 155 628 |
| CH241-291B18 | 107 104 | 3 | 23 331 | 45 533 |
| CH241-419P11 | 73 186 | 1 | 73 186 | 73 186 |
| CH241-442L16 | 58 892 | 1 | 58 892 | 58 892 |
| CH241-712C2 | 140 175 | 1 | 140 175 | 140 175 |
| CH241-503B2 | 11 519 | 1 | 11 519 | 11 519 |

DNA was prepared from the purchased BACs (Table 4) according to standard laboratory procedures and, for each BAC, purified BAC DNA was subjected to sequencing using the Pacific Biosciences DNA sequencing methodology which is capable of generating long sequencing reads. Following sequencing, generated sequencing reads were subjected to de-novo assembly whereby individual reads from each BAC were assembled together into one or more contigs. The resulting assembled contigs were subsequently used as templates for alignment of the short Illumina sequencing reads from Atavism individuals CG1, CG2, CG3, CG4, CG5 and CG6 as well as the DNA pool comprising normal horses. This alignment information was used to determine sequencing read depth in windows to identify BAC-contigs or parts thereof where depth of coverage was consistent with the genotyped of the Atavistic horses, ie. CG1, CG5 and CG6 are of genotype Del1/Del1 and will therefore entirely lack high confidence read alignments for BAC contig parts corresponding to Deletion 1. Individuals CG2, CG3 and CG4 (Genotype=Del1/Del2) will have approximately half the depth of coverage compared to the pool of DNA from normal horses in the BAC contig parts unique to Deletion 1 and entirely lack coverage in the parts shared between Deletion 1 and Deletion 2.

used digital droplet PCR (ddPCR) (Biorad) to genotype 39 Swedish Shetland ponies, 18 known carriers, 6 affected horses and 15 unaffected horses, for the two deletions (D1 and D2). The six affected horses were the same as used for sequencing and we confirmed that three of them were homozygous D1/D1 and three were heterozygous D1/D2 (Table 3).

TABLE 3

Results of digital PCR analysis of the SHOX locus in horses with or without skeletal atavism. Three alleles occur at this locus: WT = wild type, D1 = Deletion 1, D2 = Deletion 2

| | Genotype | | | | | | | |
|---|---|---|---|---|---|---|---|---|
| Horse[a] | Failed genotyping | WT/WT | WT/D1 | WT/D2 | D1/D1 | D1/D2 | D2/D2 | Total |
| Affected | 0 | 0 | 0 | 0 | 3 | 3 | 0 | 6 |
| Carrier | 4 | 2 | 8 | 3 | 0 | 0 | 1 | 18 |
| Unaffected | 1 | 12 | 2 | 0 | 0 | 0 | 0 | 15 |

[a]Affected horses show skeletal atavism, Carriers are heterozygous for a disease causing mutation while Unaffected may be homozygous wild type or heterozygous for a disease causing mutation.

It was possible to trace the inheritance of these alleles from known carriers to affected offspring. All but two known carriers for which genotypes could be determined were heterozygous for one of the deletions (WT/D1 or WT/D2). All unaffected horses carried at least one copy of the WT allele. Thus, it was concluded that skeletal atavism is caused by two different deletion alleles associated with the SHOX locus. Affected horses may be homozygous D1/D1, heterozygous D1/D2 or possibly homozygous D2/D2. We have observed one carrier with genotype D2/D2 and this individual is not reported as affected suggesting that the D2/D2 genotype may not be associated with skeletal atavism at least not in all individuals with this genotype.

CONCLUSION

In conclusion, two deletions in the SHOX gene causing skeletal atavism in horses have been identified. Methods for

TABLE 5

BAC sequences identified to contain Del1 and/or Del2 sequences

| BAC | Scaffold | Size (bp) | Comment | breakpoints between | Del1 parts | Del2 parts |
|---|---|---|---|---|---|---|
| 194E12 | 194E.scf012 | 155 628 | This scaffold comprises a breakpoint and part of Del1 | Normal/Del1 breakpoint found between 133300-133500 bp | bp 133300-end SEQ ID NO: 111 | No Del2 part |
| 50P17 | 50P17.scf06 | 147 467 | This scaffold comprises a breakpoint and part of Del1 | Normal/Del1 breakpoint found between 82200-82300 bp ? | bp 82200-end SEQ ID NO: 112 | No Del2 part |
| 291B18 | 291B18.scf718013 | 37 613 | This scaffold comprises a part of Del1 | | 1-37613 bp SEQ ID NO: 113 | No Del2 part |
| 291B18 | 291B18.scf014 | 44 786 | This scaffold comprises a part of Del1, a breakpoint, a part of Del2, and another breakpoint | Del1/Del2 breakpoint found between 5100-5500 bp, (5100-5400 bp rich in repeats*) Del2/normal breakpoint found between 25500-25700 bp | 1-5100 bp SEQ ID NO: 114 5100-25700 bp SEQ ID NO: 115 | 5100-25700 bp SEQ ID NO: 115 |
| 52P20 | 1698_contig | 66 087 | This scaffold comprises a part of Del2 and a breakpoint. From 53700 bp contaminated with vector. | Normal/Del2 breakpoint found between 37800-38000 bp | 37800-53700 bp SEQ ID NO: 116 | 37800-53700 bp SEQ ID NO: 116 |
| 712C2 | 712C2.scf702 | 140 175 | This scaffold comprises a part of Del2 and a breakpoint. | Del2/Normal breakpoint somewhere between 59400-59600 bp | 1-59600 SEQ ID NO: 117 | 1-59600 bp SEQ ID NO: 117 |

*The Del1/Del2 breakpoint was found in a region rich in repeats not making it possible to exactly define the position of the breakpoint.

Genotyping Using ddPCR

Among the six affected horses, three were homozygous D1/D1 and three were D1/D2 composite heterozygotes. We detecting the presence of these deletions can now be used to identify unaffected carriers of these mutations and use this information to avoid the risk that a mating will produce an affected offspring. In matings between two carriers 25% of the progeny are expected to show skeletal atavism. The deletions can be detected using digital PCR or quantitative PCR.

REFERENCES

1. J G Speed: A cause of malformation of the limbs of Shetland ponies with a note on its phylogenic significance. *The British Veterinary Journal* 1958:18-22.
2. W A Hermans: A hereditary anomaly in Shetland ponies. *Neth J vet Sci.* 1970, 3(1):55-63.
3. Shamis L D, Auer J: Complete ulnas and fibulas in a pony foal. *J Am Vet Med Assoc* 1985, 186:802-804.
4. Tyson R, Graham J P, Colahan P T, Berry C R: Skeletal atavism in a miniature horse. *Vet Radiol Ultrasound* 2004, 45:315-317.
5. Wade C M, Giulotto E, Sigurdsson S, Zoli M, Gnerre S, Imsland F, Lear T L, Adelson D L, Bailey E, Bellone R R, et al.: Genome sequence, comparative analysis, and population genetics of the domestic horse. *Science* 2009, 326:865-867.
6. Li H, Durbin R: Fast and accurate short read alignment with Burrows-Wheeler transform. *Bioinformatics* 2009, 25:1754-1760.
7. Li H, Handsaker B, Wysoker A, Fennell T, Ruan J, Homer N, Marth G, Abecasis G, Durbin R, Subgroup GPDP: The Sequence Alignment/Map format and SAMtools. *Bioinformatics* 2009, 25:2078-2079.
8. McKenna A, Hanna M, Banks E, Sivachenko A, Cibulskis K, Kernytsky A, Garimella K, Altshuler D, Gabriel S, Daly M, et al.: The Genome Analysis Toolkit: a MapReduce framework for analyzing next-generation DNA sequencing data. *Genome Res* 2010, 20:1297-1303.
9. Blaschke R J, Rappold G: The pseudoautosomal regions, SHOX and disease. *Curr Opin Genet Dev* 2006, 16:233-239.
10. Rosilio M, Huber-Lequesne C, Sapin H, Carel J C, Blum W F, Cormier-Daire V: Genotypes and phenotypes of children with SHOX deficiency in France. *J Clin Endocrinol Metab* 2012, 97:E1257-1265.

SEQUENCE LISTING (117 sequences)

SEQ ID NO: 1 - DNA, 20 bp, Artificial Sequence
  Primer
tccccgrgtgtggaaagtta

SEQ ID NO: 2 - DNA, 20 bp, Artificial Sequence
  Primer
ccacaaagcacatccgttta

SEQ ID NO: 3 - DNA, 18 bp, Artificial Sequence
  Probe
acgggaaggagggggccc

SEQ ID NO: 4 - DNA, 20 bp, Artificial Sequence
  Primer
ccmgcttttgtcccttaaac

SEQ ID NO: 5 - DNA, 20 bp, Artificial Sequence
  Primer
tccaggcgatttccaactaa

SEQ ID NO: 6 - DNA, 20 bp, Artificial Sequence
  Probe
ccagctctgggctcggctcc

SEQ ID NO: 7 - DNA, 19 bp, Artificial Sequence
  Primer
gttccaagctccggctaag

SEQ ID NO: 8 - DNA, 18 bp, Artificial Sequence
  Primer
ggaggtgggttcccagag

SEQ ID NO: 9 - DNA, 18 bp, Artificial Sequence
  Probe
tctgccctcgcgcggagc

SEQ ID NO: 10 - DNA, 15572 bp, Equus caballus
ccggcgtcctcaccgtctctaccccagccctaactggatcctgaccctgaccctaagcctaactcgatccgaccctgactgcagccctgaccctgaccctgagccgcctgccctggcgactgtcccacctgttagatacgcagatatctaggggaaaaagtaaagcactatgaggcatggagagcacagctgtgctgtgattcgagtcttaagtggcctattgtagcagacatcaaatggaaagaaattgagcttactaggtttctcttttggaaaacttttcatagctgtttttgtaacagccaagcaggatgtgaaagcagagaagccctgggtgggtggccagtgcatggagtggaggaggatgtgccaggatggaggagggcagctccagccagccacaagcgcctgcagagccgagcttgccctttctagaagctcctgcagtccacactacagcacaggccacatactcattctgtgcaccgctccgtttcctcctgttttccgtaagcaaaggatgtaagtatactcacagtcagggtcaggctcctgaagactcaggtatcaaacattgcctgtcagtttgcttctcaaactgttttaagagcagtgtaatttatcctctaaagcaatttcacagacatagggagtctgcttagtttcacagcagtgttgttgaagatgatacgaaggagatgcagaaattttccagaaaaatgggctaaagcaggctttaagaattccttacaaaaaaaggtgataaacttaaccttctttttcagatgttttacaggtatgacataccctgattaagtgttcagaggattatatcccgtccccagtgcagcgtgtagggtttgctttgcgacataccagggagagatcaaaagggagggagacctcagcgtgggagggaggagccaccacgtatccataaatgacaggcatccttgtgcgggcaaagcgaaccctgccaacatgaggaccctgtccctgagtttctgctctgctgccctccagcggcttccatgctcaagtcacctcccagcccacggctgagggctccgaccatcacatgtatgctccacagctgcagcgagacgagatggcagtgaaggggctgctgcctccctcccagatcctccccggaaatcgcacgctgcccttctactcgaaacttagtcgagtgagcagcccagagtgcagggctgccgcgggtgctctcctgctctgtacggaagaggaaggagagggcatgcgttaagatggcggcagctcctgtgacagtgtcatccgactggaactcacgtggaatcccgacagtgacctgacctgtggccggtcctccctgccactgctggatctagggactcaggctcttcgtcttagagatccgccctcctccaggcctcccgctgtgtcccctggcctgctttcacagagtgaccacaggaggaccctgagccattctggctgtagatttctaaatgttttttactttagtttttggtactcgtgcagatttgcgtgtgtgaggtgtcgttctcagacagccccacgccctgttcatccagacccattgtcctggtcgtggtatggccccttccctttcttggactctcgccactcacaccccatccagcatgcagctcattccccacaactcacggctccatgtaaggtcctggatgacgaggtatccggtgggagaagctgttagagaaaagaggtgcttgcatctccagggtctgaggtgtgtttacagtcaccatggaaaccccagggcagggttttgtgggaacaaagctgcagccttgggagtgaccagaccacaccacatggccatggcgcctctcctctccccccaccaccaccctagggtttgtgggttcatgcgtcctgggctcctggagacagcggtgcagtgagactgggcctgcgggccccttacgtatttcccacgtagtggacatactcgtgggcaggtcgctgccccagactcaatcattcagtgtgttgaaccaaggctctgggatggggcgagggggcgggggctggaggacaggagagtcatgggacaggtcttcccgcacagaggcccaggaggggcagactgagggggtcccccagggatggggtcactgggagtgaacttttggggaccctttgtgacctgcctggagcgggggagcacatggtgagtataaatggccagtgcccagggcctgatgccaacagagggcctgaggagggcgcattaccacctcctgggcctgtcctcggggcatcagccctccctccagagaaggaaagccaggtccctgcacaggtggagatgtgtcttcaacggaagggccgggtccagggctgaggaggagcaggggatcctgggccaggcagccccacagtgtcagggctcttacccagcatggaggccacacctgccagcagggtccagagctgagttccaagatgactcggtgtgtgaggccctaggacctttacctgtgactgccttgccctgcggtgtacgacacggaggccattttctttgggcgagttcacaaaaacaggtggacccggagttggcaaatttatcaccagtaaggaaacaaataggtaaaacttgttcgtcatttgatgaaaagcttaagtgttgcaaaaatagctttcagatcttctaggaaggaactatcgatcatccctggcgtggtgccttggccttttctctgcactcagagtgctgatggagaaattcaaacattgctgaaaagtccactgggtgacttggggcaacagggtttaaagaccgtgctggacgacctggttccactgggcacgttacaataagggggagttttgaccaagtcctggggcaaatcgggctcttggggagcctgagaatcgagggaagcccttgcctgagcccttcccagctaagggggagtttgaggttccagaggtgctgagggcacacgaggtggtggatgggttctctcatctcattcttctgaggtctgactctgtcgctcacccagaaccctgacacatgtgtcccctaactcgcagctgtgaccctcaccaggaattccctaaggctaagatctgcaaacagtaaactatccagcattgcagaaacctcatgacccctgtaaaccctgcagccctcgcctgaaaccccaccctaaccacaaaccccaacctgggatttgcccagggctgaaccccaaacataagctcccccaaccctgaccctaacccctacaagtcggtctctctctcactgtggttcccacgcagaagcgggtgtcacccgtagcagctgccctgcagggagcgcatgggatgtgacgcaggtgtgtggcccccacggaaacaccaggggccagggacgagaaacgggccgggtggccggggcttggagagggtggtctgggcaggggcgggctctcgttggaggatggagcccacgccctgcgggtccttgaggtcagaggctcctgggaacactggtctcaggggcgggagctggaggccacatggagctcttggagtttgagacacttctgaggttcagcaggatctgtaagttctgggcccctgctaacatctccctttccaatgtaaaatgtaaactcccctaccccgatctccccacggtgcttttgcatctgtgtagcctacttccattgagtggactcgagttgaaattagatgaaggatgggtctctgcctggatcacaggtggctttgaactccgtgaggtctatataagaattctgcataaatacattctttggctggaatggaaaagtatcccagtgcatctgaagtatggtgacagtcactagactgtgtagatggggaccggagggtctgagtgttattctcctcctgggtgggtctggtcaccgccgtctacctgttgttaacttgaccctcaacagtgctggaggtggggaggaaccacccagcttctgagaattcaccttaataaatgtcgtaggagccggtcgcctccagagagctcacacagcactcgcggcccatccccatcctgaacggttcatgtgtcaactcgtttaggatgcagagcaaaccagtgaggaaggcaatattgtgggacgtagggagtgagtgcagagggttcaggtttagaaaatagatgtgtgtgacatatacgtatgagcgtgtgtatacgagggggtgacttctgcccaccgcacagcactgctctgagggtcacactggacaacaggtagatttatgtacaaacacacaaacgtatataaagtctccatttcttgataacttgcccaagaactcacggccagtctgtggcaaaatttagacgtagacctgggcatcatggctcaaacctgcgcccactgagcccctgtccttttgaccccaggctgcccctggggctctggactcctgcaccagctcagcttcccatccagccgacacactccctcagcctcatcccgatttgctctgtggagcccatggggaggctcaggctgccagttccccgaggcccaggggaagagaaacccagcaggcgccgccctgagatcacatggggcttcatgtttgtggaggctctgctgacctctgaccctgaggccccacggtgacctcgccttctgtctccatgggtctgagctgccactggagggcgttggtggcccttctgtgtccctggtgttgtcatcagtgacatggcaggggctccatccttcctggggtgatggaataggggctccatccttcttggagtggccctgccagagcaggcatgctagtcccagggtcctctgctccaggggcctgggaacccgggtcgggggcacatgcccggggagaccaccctgtggaagggggtcggcattcgcagccagagctgctgctgcctcagatcgtcctcgtgacgacagcaaacaggcccgcgccctggtgtgctgggcccaccctaagcaccttcacgcccacaagagccctgtggtgtagaccgtgttgtgatcccattctgagacagacaaaggaggcttagagacctttgataacttgtccaaggactcacagataattggcggaggcaagatttgaacaaaagaggcagtctgactccagaagcccgctagccaccacgcttcactgatttctgctagaaatcactgaaaagagaactgcaagaccggggagcagagagaacgggaaggattgaaatgcggagagaggagttgggagtggaggaggaagagcggctccaccagggcggctggagtggaagtggaggggcggccaggatgggagacaagaggagggggacccacccgaggagatgggacctaggacacagcctgagcaggaggaacgatgagcctggggtagaggatgaggggcagagaggaggtcccagggttcagagggggatcggagccctggccaccaggagccagcatgttccctggggcagtgggagcccatggcccgttctggcacaggctccagagggctctgaggcagccggctccccagaggagatcaggcagggctctggggtctcacgctggccttcagcccctgccttgaggactcagactcccctattccagcagccgtattccggagtcctcgggggtgactctgaggtgcacacactccccctgccctctgaccccaccctggcccacaggccctttctctcctcggccaccgtgtgaggcatgtcaggctgagcccatgctgagcagaatctgctaagtatccagatgcggtcagatcagcaaaggtgggtcagggattccacctggactgctggctccgctgcaggtggctgggagtggaaggacagggtggggctctcagggttccttttatggggcggaagggtgggcaaggagtaccctcaggcctgctgccccttcttgcggtgtcggtgttagttggcattcctcctctggccatgtgtctcccccagcccctcgtgaagctgactcgggcactttgcaggggctgctcgtccgccttctctctggcacacggggcccgtgtgaggcaaagagtcacctcggcccgagcagccaacgaggagcacatggttctgacaattcctgtcccctgagggcatattctgggcccgggccctgccgccccgctcactgaagagacgcacctgcagccacagcctgtctgtcccctgacagtcccacgggtgggagaggagaccaggtccctctgggacacgactcgggaagagcagccacatctacttggaaggacgagatgcccgggaactctgggagggaatgaccacggaggcatcaggtgtgttgggtaaggatgacaagaccaacccagcaaggacatgggcagtcccctgcagaaactgaggtctctcactcagaattcaggggaagtgggagggtcaaagactattctggaaagacagaactggacacacaaaggttggaggtgagtgagagcatggacagcaagtgaccagacagtcactgctgttgggagaggggtgtggggagggtgtaggcagagaagctgaggggcagccagggtgggctgtgtactcagggccacagaggtaccgaaggtcatggagtggggaatggccatgaggagccgtctcctacaagggtcactctggctgatccgtggaggatggcggaggcgcgaggcgggaggcagggagaccgtaggaacctagtgcagttgtcctggagatgatggcagcccggcctaggagagtgctggggactgggagggaaacagctgctgtcagtggtgcggtcagggaactggtgacaagtgggatgctggggcccgggagatggaggagtcgaggactcccaggcctcaggcttgcactctgcagtgcgttgaatggtggcccccgaaaaacatatgtccatgtcctcatcctcagaacttgtgaatattatgggatatggtgataaaagatgtgcctaagttagggatcttgaggcgtttatcctgagtaacctgggtgggtcctaaacgccatcacagggatccttataagagagagacagagggagaacagagacactgagagacacagaggagccatgtgaggacagagagagacaggagggaggcagccaccagcccagggaccctggagccccagacgctggaagagggaggagggaccctcccctggagcctccagagggagcacggccctgcgacccttgacctcagactctgggctccaggaggggggagggtggattttgaggcgcccagtttgtggtaacttgttgcagccgcctcaggaaactcacacaccactcctgggggatggtccctcatcagctccagggtgcagggtttggcctggagaacctgaggaactggacagcgtggagcccactccacctgggtggaggttccccgggagcacaggccctcggctcagagcagaccgggggtggagagggggtccagcacggagatggtgcttgaggctgtaagagagaagggggcatcgggacagtgtgtccaccgaggaggcgcaaagaaagccaggctggaagaaaggtgtcaccagggggaagttgaggggaccctgggcagcggcttccagcggccggtgtgtctggagctggtcgctcatttcctccaactgtaaaatgaggaccactcatgactccaccgggagacctggggtggcagggagacacgagacagatgaaggggaaggattttctcaggacgcactggcaggaacgggcgacagacggagtcacatgaggagccaagggagcaaggtccacgtgacccacctgcagggggaggggtcaggcgaggggaggaaaggcctcttacctggtcatgagaccaaacgagtctggacacaaggggtggctctgtctccccaagttttctttcccgaaggcaccccgcgttgactctgctgagctcacggccttgcccagctctctgacctctgacccctgcccctttctctgcccttctcagctacaggctagacactgtcctggctttggctttagccacagggtgcacaccacgcgtcctgcctcacgtcgggcccctttgtcttagtgtctgtaggacaagggaagcggggagctgacaaggatgccggagcattctgagacaggctggcccaggtgtcctgcagggcgtctcggtccccttccccacctcttgccccccaggtctaaggtcttccttgtccatcagccacgtgatggtgcagaccaggccctctcccaaccactgcaccctttttcaaatcccccccccaccaccatctaaccaacgccatccgtgcagcctcacccctgcgtggctcagcagacctattttctggttcaccttgttccatcccagaacatctcccatccaccctgtgggtcaccccaggaccaccttaggagttgtcacctcatttccatgacctttatcatcaatatctacaactgcccagatgtgggaaggatagccaggtggtgagggaagcacacggtgaggctcccaccccctggatggtctttgtcacctgtaggttcctgacacccagtttcccaggggatgctgtggagggagtgagcaagagaagggttccttgcagggtttgggtttttacagccaatccagggcccttctcctctgcccagcctcacagttaaccatccagtcagaagggagctgccttctggggagtctcaacaagagaccaacgcgtctgtcctgcgtgtgtccctgtgggagccgagctgggcgtctgcttatctctcctgattctcccgcaagattcccttcccgagtcttgagtaggtggtcacagtgcctcacaggggcgtggctgggctgaatctggaagagcggaggcttcagggagcagcaggactcagcggcccacggagtgttgcccaggctgagggccaggctgtgccccaggtgaagactcggggtgtcagataggagagcaccccccactggaggccaacagcaggggagaccgtgcagaccctgacgggagactctgctgtgacgacacgagcactcagagcaaagcagggaccacgtcgtctcagtcctgcgtcttcacaacagctgaacaggctccaaggcctccgagctcacgttagcgcttccttctctttactgcaagggttttttttttccgccttttctccccaaatccccccagtacataattgtatattttagctgtgggtccctctagttgtggcatgtgggacgccgcctcaacgtggcctgatgagctgtgccatgtccacgcccaggatccaaaccagagaaaccccaggccaccgaagcagagcgagtgaaattaactgctcggccacgaggccggcccctctttactgcaagttttatacaagttcttagcagctggattcagatgctttctacaaaaacacaaaggagttcaccacacgcactgcaagggtaaccctggctctacccgaccttcctccccgctgggagctcaggcagcgcagggcagggagaggccggcctgcagggcgggggcagcggcggggacagggacgctgccttcccagcacaggcggggccacagggagacagagagggcaggctgcatgtgggccccgcaccagcaggagcagtttcacactcgcctttggttttacgtgtccttctgctcaactttaacaaacggacgtttagcaacaactaagacgccatttgaacacctggtttcaagcctgtctcttgccccagacgacaccaaagcaccgggcgggtcctgtggccgctccctgggcgctgcagcgggtcagggacgcctctggacaccccgggacctctccccggggggccggctccctcgccgcggaacaaacagagcaggctggtcccccggccggggctcagatgctgcaggcgggccgtctccccggcgcctgcgtctcccccgtcacccccgagggactgagggaggcagggagccaggcacgtgttagtgcctgagcaggaagtcctgtgctgaacggtgtccccaaattcacagattgggtcctgacccccaggacctcgggatggggctgtgtttggagacagctcttcaaggaggtgatggaggtgaaatgaggtcattaaggggggtcctgatccagcaggactgggggccctgtgacaagctgcgtttcgcaggttcctgtcagacgcaacgtgcacattctctaccaagtgtctgcgattgcagcggatttgctcgtttgtattttaaatgagaccggcttgatgtgagcatggctgccccactcacggcctcctggggaggcacaggcgggaggcagcggggtggcaaatgctccgccaccctcactggcagcctctgaacaagcggtcatcacagatgcattcacctgagcgctcttttcataagagcaaaatgttagaggcccctaggcacgcagtggcagggtgactgcactcatcagggcacagacgctaacgagcatgggcctcgggacccgctgctcctccgtctgcagagccccgctcggacggtctcgtagtaactgcattaacttagttgtttaacgacatacacaaaagtttgtaatatgcaggtaagtgaaaaaggcaagatgaggtgtcaggcacagcgtgaccacatgcttgataaacgtaccctacctaccttcacacgagtatttttttttaattgttttattgaggtcacctgccgggggcagaagcaacatttgatcagctgtttgacagggtccagccgatcgagaagagccgaggggtgcagggtgcccctccgcaagaaaatgaaaagccagccttcccccaagctatgctggactttgaaaacttgtttttcttctctttgtctcatacccccttttcctgctcatgctgtaattttccagatggccgcttcagagaaaagggcatgctccccccgcggggttggtgctgagaaaaataagtgagcacctgcacgtagccttcaggatgtcgcaaggggcaagttccccctgacgcacacagatagtgggagaacattcctccctcatgaggggttcgtactgaagagagcgtttggatcaaagcagctgcctccttctggttgatgttttgctcttcccccagtttccctggtaagaatagatatacctcttcctctgtagttaattagaaaattcctccatatgttagttattgaaaacacattgtttcttgtagtgtgtttggcaagacactatagaagtctttttcttagaaactgctgataacagacattactgaagtcgcttttgtgcaggaaaagatagttaacctctgcccccctaaaagttaactctgttccctgtaagattatacttatcaatgattgccttttggtttactctgcaagaacacctgtactgctatatttatcccctgctaaaaaagatataaaaacgctgtgaaaaccaagtaaagctaggcttgcttgcgtcgacatcaagtctcacgtctcttgctttcacttcgccgactccgtctctcccttcgggagcctggactcagctggagcaggactcctcagtcaccttggtttataacatcgtgtaacttcatgtgtacgtcattacatttcggattctgtgtagactgcgtcgtgttcaccaccaaaagtctagtttccctccacgaccgcgcacacgtgcccctttgcccccacgcccttcgcctctggcaaccgccagtcaggctgtgttcctgccgactccgtacgtacaccccacaacgcctgcagttgaagtgtgaacacctgcactgctggcgttagcttgacaacctactgtgacttagcttttgtagggtttctggaaccatgaagcatcagagagtcagctagtgtgtaattcacatatcacacggacccagagaccgtgcctgagcctccaggcgaccccaccgtggcacccaggtgaccccactgtggcatctaagtgaccactgtggtggaagcgcccagctgccggccagaacccattttccttcctcctgctcgtgtgtactctgcatccctagcctaccccctccttttagcgtgggtaccacgtctctgggtgccaccaaggggaagtgggtggagtgatgagggcctcggccaggctggatcttaggatgaagggcatggctcccccagggtcagcccaacagcccaccccctgctgattggaaccctccgtccgggaggagggaggggaaaccagagggaccgagcctgggcccctggcccacggtcctggagtctcccaggacgagagagatggcctggagctctcagccctggattgctgggacgctctgttccagtaacagactttcaccttaaaaacataagtgcaggggccggcccggtggtgcagcggttaagttcacacgttctgcttcagcagcctgggctttgcccgttcggaccctgggtccagacatggcactgcttggcacgccatgctgtggtagacgtctcacacataaagtagaggaagatgggcacggatgttagcccaaggccagtcttcctcagcaaaaagaggaggattggcagcagttagctcagggctaatcttcctcaaaaaacaaaacaaaacaaaacgtaagtgctctgcaaacccctccggttctaacagaaactgaggcttaatttaactgacacttttctccaaccgcagcccacagtgaagggacgacccagaccatcactcaggtcacagtgctgagaagtcagggtccctttaaaagatcagctgagctcggctccttgccagctctgccttctgcttccaggagattccttgacaaacctgctcatttccttaacaaccaagtttcgcaactgcccaagttgccctccttcaaacattcctatttcagtcttgcagacctaaagtgacagtgctgtcctgaggcgccagcaaccgattcctctgaacctgtaggtattgcttacatgacgttattaatgacaaaattccacgagaaccagctttccaggctaactagttctggactcggccctgggtccctttcccacagagagggtggtggaactgtccccatggcctcgtggtagaagagctcacgttctgacggagcccgacctcagagcctttgcaatgtaattgctgtcagtaccagtctgtgtaggaccttagtcatctcctaagatggaagggtcgttttatacacagatagtgaggcgaatggtggcccccaaaagatgtgtcccctagaatgtgtgaaagtgttgttatttagaaaaagggtctttgcaggtgtgatgaagggaaggatggagaggagggcttcctggaataggcggccctgaatccagggacagcgtcctcatcacagacagaagaggagacgcagacgcagaggagcagccccgtgaggacggaggcagagacgggagggaggcggccaccagcccagggaccctggagccccggacgctggaagaggcaggagggtccctccccgggagcctccagagggagcgcggccctgcgacccttgacctcagactctaggctccaggttgggggaggatgggtccctggggtttaagcccccagcttgtggtcacttgttacggccgccccaggacactcacacagaccctgttctgtaggctcgttaaaggtaggtagtggccaggtcacagaacccttagagtcagcgctgggccaacggaagtcctgcagcagtctggagcccagccccaagggtgcaggctgcacgtgggcctcccgggttcatacaccttgtacgtgtggaggcgtctgaagcatttcagtctttcatcaaggaccttcactgtcagcattcaggtcgctagataagaatctgctccttacagcgatgagagcccattggctacagggggagaacccgctggagacgtttgcaaggctggcaagcaaagtctggaatggagcggaggtggggggagccagggagtgagggacgctctcctgtgatgtctgccgagtgtcctcgctgggaagctggtggactcaggagtgtctctgactgactgactgagctgaccctgtgccagccgctcctgctgtggtttatccacccctcgtgggtgacaccacacagaacacgtgcaaggacctcaatgctgggggagacggcctggcgccaagccagtaatgacacacgacggccaacaccagcgccttgggaccacacggggtggtttcatccgtgctcttgtgggagctgcaggttcgcctgtcacccccctttcctgagccccgcccctagggccttcttcttgctccccacctccgcatgggagaacctgcaatagcaggtgtgggtgatgcattctcttctcagcaggtgggggcccagcgcttcctgtggacggttccagccaaggttagcgtggcccctcactccctccgcactgatggggcaggaagtacggcctcaggctcctgcttcccggaggggcatctgtgacctccaggctgctgggccaggcctgggtcaggctgccaggccggctgctcctcgcatcaggagctggagttgcagaaaccggccttgctgcagccgccaggagcaggtggggatcacggggggtcaggtggacgtggggacgcggctccggtttgttttctatgtcgtcttaaccggcccgcgagtgaggcaacctcaggaagaccctcctctcaagagcctcgaggagtcggggagcaggggtggagagtgacaccgaccccagggcgcccagatgcagccggcccagctatgtgcggcccttcctctgcgcagcggaagcttctggaagtgcgggaggagggagcccagcacagagttcaagccagggccctccgcacagtgggggggacagacccatccagagcagcagtttgttagtgtgggtcctgctctggccaagaggtgggactgggggtttcagcaacgagggctgtgcgctcgtttcctgtctgcggagccctgcccgggtgagccctgtgtccacggggcgtcagcgggggtagaccccgtgtcctgggagctgccggagcgtggacgcatgcccacactggaaacctcaggcccagtgcgcaggagccctcagggccgtgtctgggcccccggaaggcggagggagcacgctgaccccggcctcggccccgtccccgtccctgtccctcccaggctgccccgtctctcagcccgcggtgggggcagcgcaggctgggccccgtccgcgtgggaggaggcagcggcggcttgtgcacgtggcatccacgcggggaacacgcgcggggacgcgcgcacggggcagggggcggggcatgagtgggaggggcctggagcctgagtggcaggggcctgggggcctgagtgggagggacctggggcgctgtgcaggggaggaggctgagtgggaggggcctgagtgggaggggcggggcctgagtgggaggggcctggggcactgcaggggaggagcctgagtgggaggg

SEQ ID NO: 11 - DNA, 6050 bp, Equus caballus
agaccggaggcagcgacccagccctggcctccggggtcgggggggacggctgcgggggcagggcctgcgcccccacggcgggcaccatttttctctgatcattggcgaacacaggactgttgctgtagagggtggactgtgacaatggaggactattactgtagagggcgaactctgataattcaggaggcctgttactgtggaggggggaccatgatgacagacagagacgactattgtagtgggggaatgtgacgttagaggagaacatactgtatggggaactgtgacagtagaggggagctattactgtagaggggaactgtgataagagaggggaactgtgatcatagaggtggactctttctgtagagggggattgtggcagtagatgggactcttactgtagaggggggactacacaataaagacaactccccagcccagctctgttaacctgtgaacaggtgggtaaaggggtttctgtggagacagtaaaccagtgccaggggtgtgggcggggcaggggggccggcctgggtggtggacagagggcctgtggactccggcaccctgaggcggcgtctgctggaggctggggtgctgtggtcagctctggggtggagatggaggacgtggcagtggccgcccttgctctgaggcttgtgggacaggctttcgtcgtggcgagtgctttagggtccggtacatggcctggagccaggctgggaacggggtccatgcggccttgacggtggacgggggccggggtctcctctaggtctcaggggaagggccctcgcaggaagcttctcgcggacacaggggtgtgagtgtgtccctgaccctcaggtgacctttgatactgtcgggggccaccgtccccgttgtaagtggggaaacagaggcacaggctggaagcgagcttggggtcccaggggtcgcagtgcagggctggcacgcttggctggtctctctctctgtctacagggtgttccaggctccccttttttccgctgtgcaaaccctgtgtcgtttcgcaggtcagtcgtgcgggctcctcgatgggcgggcagctgagcgcacctggcggcggcgggagcctgccacgccccgtgaacgcggactggatgtcggcgctgtgcccgcggctctgggacgtgcccctgcaccacctctccatcccgggtgagcggctctgtggccgggggggtgctggctgtgggctgggctgggctccaccaaccacacacgtgtgcacacgcaggtacacacgaacacgcgcacacacacacacacacacacgtgagcagcttcatctcagactctggcctccgggacgggggagggtgaattctgtggtttaagcccccagtttgcgctccttcgtcacagctgcccccggacactcccgccccgatcacctcaccaccgaaggcccgagtccccgtgtggggtggagggtcaggtgccgggcgtgcggggacaaggcagaggcaggcgagcccggctggggtcccagctcagcattcgatgcgcctcgggaccctccttgcagccctgccggccggcggccacttcttcctgggggtccggctcccttcacctcgccgtctctgcctgccaggcccgggctggggcgtccttcccgggcccaggtccctcccaccaggaccaccggccaccggggcgtcgcgagggcacggagttgggcgcccgcgggcgtgttcatgaacaaggcccaggcggtgtgagagcagagacgaggccgccgaccgcacgaccagactgagaggtgtcgtccacgcgtgggaatccagaagacgctgttcgtggccgagtcgacccgtcagaacaggaaatggaaacacccgccgtttacagaaacagtaaaatgtgaaatgcatgaggcaagtgggacgatttgccggctgcagatgaaggaaaacggagcctccggtcgggagtcgggacgaggatgcgacggaacgaacgagagatgcacctccaggtcgacagaatggccccttcccgcccgtccgccgggacgaaggcggtgccggcgtcagagcgtctgagaagggagagcaggacgggctctgatgtgctcagtggtgacgtgcagatttcacacgcagatgacacagggcgtttgtaaagctcccctcaccgtccagacccgctgtcggtgacgctccaggtcggtggatccgaacattgaattcaaaagtggctacaactctgagaatgtaacgtcttataaacgaggaggcgtttcacgtctgcgcacacagggttccctcgacggtgaagaggctccaggtggctaataatgtggaggggggatcaggcgagatgccgtctcatgttttacagggagacgtgtcacagaatgttcaaagatttaagtgaaacataaaccacaaagttctgtcggaagagacaggtaaacaggcccagatactagcttttctgaggaaaaccccaagcgcaggagctggggaggaaaaggcgggcagactcgactcctaaacagacattgaggtctcccctcattaagaaacttaaacgctgaggacagtaaaccccgtaacggagccgaacagcgtcctcaagatgtcgccacgtcctcgtccccgcggggcaggcaggacacggccccaaagacgcccgcaccctcgtccccggaagctgtggatacgtttgtctcatgacaaaagggtctttgcagaagttggttccttcagggtcttgaggtgggggatctctttggattatctggggctcagtgtggcatcgagggtcctcgtgggagggaggcaggagggtcacagaggaggcaggaggaagattctgtgctgcaggctgtgcagaaggaagggcccgagcccaggaggcggcccccaaaacgctggagaagacaggagacagtcctctcagaccccccggaaggaacctgccgggcccacacttagacttcagaccgtgtccgatttctggcctctggaacgggtaacacgtctctgttgtttgaagctgcctcgtttgtggggctttgttacaggggccccaggacccttgcacagccacccagacggtggatcctgcatggtgagtccctcctggggcactgcctcacctgagggtgctcctctcgcgtccttcccagaggccacctgcccccacgaggggatgcagaggatggagcccccgggacgggcgcctccctctgccctcgccctggctcttcccagagcaatccccactgtcccccacgtgccgatctcgtcccaggacacccagcccatgaggaaccagaaaaccacatccacacgcacgtcacgcacaacaggccagggctgctgtgtccacatggggagggttaggaattggccaatggcatgtgctccccagcagaaagccgccgagccggacggacgattctgaggagaaaccctgacgactgggacatcacgaggggtggcccatgggatgaactcagtgacgcagcgtccagagcgaccagcaaagctgggagtgtcggtgccaaggggcctggggggcggccgcagggtcccctccggtgggagagactcgggatgccggcagagggctgagggctgcacactgggctcctcccgcgcccccacagtctacttcaaggctccgtctgcaaggggggctccgtgggtgtgcaaaccacacgcacccacgtgctcacagcgaggctgcctccatgggagacgccagccctcacgcccgggatgctgtcaggtgcacacgcggccacgtcaccgcggtggacacgggcgttagaacagatgaaggctccggactgactgctgcacaaaacgcgagtaatgtgtgagtgaaacagcagagaaaaacctgcgtgattcggtcctgtttgaagtatctgagaaagaatagataacaaagtaaaatgggtcatccccatgtataaatggacccatatatatcatatttaaaatatataaatatgtaacacataaaaaacatataatgacaatgacaatagaggattttaatgtttttacttgtctatattttcctcatttttctgcaattaacatgagttcccaggtgtgtgactgtcctggggcggctgtgacaaatgatcacaagctgggagcttaaactcccgggatccgtcctcccccgtcctggagcccagagtctggggtcaagggtcgcagggccgcgctccctccggaggctcctggggagggtccctcctgcctcttccagcgtccggggctccagggtccctgggctggtggccgcctccctcccgtctctgcctccgtcctcacggggctgctcctctgcgtctgcgtctcctcttctgtctctgagaaggacgctgtccttggattcagggccgccccctccaggaagccctcctctccagccttgattcagggccgcctcctccaggaagccctcctctccatccttgattcagggccgcctcctccaggaagccctcctctccagccttgattcagggccgcctcctccaggaagccctgctctccatccttcccttcatcacccatgcaaagactctgtttccacacaggtcctgggagtgggtttggcggccgtcacccaccccctgtgtgcaccgtccccgtgtgcggctctgagcacagggggcaggaggggctggtgggtgactgtctccttggtgtcactgcagggagccacgacacgatgacctactgcctgaacaagaggtcccccatttcccacagccagtcctggctgctgcagcttctgggcaagctcctgccgtgcgtcacccggcccatggtgctcaagtggtccgtcacccaggttagggtctgcacatgtcaagtgggctcctgagcagcgcgcagcgccgtcctggctgggtggcacctgtaaccgggaaggagaaatggaatggaacacaaacctcctccagcccagaaagccccacccccacagaggtcagggagaaagaacggggttcactagtgaacaaggaagggaccaggcgtgatgtgtgtcacaggcagccactgcagagtgcagaggcagacggagctccacctcgcacgtagctaagcagaacacgcgtcccatcatgttctaagggaaacagtcactgacttcccacgtctttgtgaaggacgtgggttaacaattgggagccaagccctctcgtcccaggagacaggcgtctccctcctggaccgcatgtcagagacgctccccaccctggaggacacattcctgagctgtagaatggtccagacgcttgttcagatgtgcacacgcttgagaaagttggagaaaaacttatccactacagggtttttccactcgatgctccaggagacggagtgagggcaccgtctctgcccgtgtgtttggaattaagcctctccttgaatggggtcgcctcacatccctcgtcctcagcccttccctcgtgcggatcagggggtttagggacgtgagcagctgggagggagaggagaggaagggcccccggagtcgctcaggtggcccaggctgcggggcaggggcacccactgctgtggtcccgtcaccgtgcacacacgggcaccagggtgtcaggaaagggagccaggtgctggccggaaggaaggcggggcccaagggggacccggccgaccccagccccctcccccccctgcccgggccacgggctcccgaggggccgccccttcgggctcggctttgtcctgcctgattgctgggctccccagctgcgggtgtcatcattggggtggcccggaaccccgtgtgggaatgtgcaggggtggaggggcgttcgctggaatggtcagggaaaccacgttcccaattgtgtcaccaacggccacctccaggccccgccgggaccgggaagcaggtccatagcaagccccgggggggtgctcacaaacgctgggtcccctcggaagacaagtcccctcgaggcttgtgccctcagaggcttgggtcctccggagtcgggttccttcggttgcttg

SEQ ID NO: 12 - DNA, 3442 bp, Equus caballus
ccgatgacaatgggctgatctccagattaaccctgacacaagtggcggttcacagggagccccacacaccgcacgcttgacagtgcacgcacagcagcacgcacgcacgctctccccgagcgagggcaagcgcgcggctgcatccaagcattgttgtttgcttgtcgggacggccattgcggagtttgcgcaggacgccgcggagcgtcttgtcccgggccctgacgcgccctccccccagagacacgctcaccgagatctcggagtgctggagagacacccgcgcgagagtggtcatcctggcctgcagagccttcgagaggctgacagagagctgcacgagtacctgtcgcctgcgtcaggacatcttcggggcaatgctgtgtcgcgagggtgagccggagacgcagcctgacctgaccgggacggcgggtcatcactgtgtccccttacaagacgcccggcgtctcccgtctctgtctctacagacgcccggcgtctccccgtctctgtctctacagacgccccgcgtctcccgtctctgtctctacagacgcccggcgtctcccgtctctgtctctacagacgcccggcgtctcccgtctctgtctctacagacgccccgcgtctcccgtctctgtctctacagacgcccggcgtctccccgtctctgtctctacagacgcccggcgtctccccgtctctgtctctgcagacgcccggcgtctccccgtctctgtctctgcagacgcccggcgtctcccgtctctgtctctgcagacgcccggcgtctcccgtctctgtctctgcagacgccccgcgtctcccgtctctgtctctgcagacgcccggcgtctcccgtctctgtctctacagacgcccggcgtctccccgtctctgtctctcacacacgcccctatctccccctcaggaggtgccgacgctgcgtcagctgtgggcgcggggccagcaggtcctcctgtcgtacgaggacgagcgcacgctgagccggcaccgcgagctgtggccggggctcccctactggtgggccgaccaggcgaagcccacggagctggtgcgctacctggagcacatgaagagctgcggccgcccaggtggggcaacgtcctcgtgtgctgtgggcaccaggctgctttcatacaaacacgggtgcacacgtgtgtaatattggatgtgtacacgcacacgcctggcacatatgcatgagtgccaacacatgattgagatacatgtacactgcacacatgcgcacacgtgtccacacacacgcctccacgtgcacacacactgggtggagtctgggcagtgcaggctcagacccccgccgggtcctgcctcagctccgcgtgacggccacgtggattcgcggggcccctgtgtccgtctgaggatgccaccgcccggccctttgctgcgggttctcctccctggtctcagggtttgtgagcttttgtaaggaaatcggcccttttctgcaaacacgccatgaataacccgtgggtgatgctcagacgctcggcggtgcttttggccccagttcccacgaagccgcatttccatagcgtgagatttgtgtcctcagggaaggcagcccgaggagcaggcggcttgtgacggagtctcccatctcagcatcctgaacgggatgacatctcaaagtcccctttgccacatagagtcacatgttcacaggttctggggaggaaggcgtggacgtcttcagggatgttattcctcccgccatcctctgtaagaggagaagttcagtgaacttgaccccttagttgagctgtgctgtcagaaccctcatgtccgtgtggattgaagctctgagcacgagaacagggagggagcggtggtgcacggtgtggccgggacgcccgcagcaccggggacccctctctccctgtcctgtttcaggcgggctgttcgtggcgggcatcaacctgacggagaacctggagtacgtccttgtgcacccagccgggtccctcaggaagatgacgctcccgcacctggcctacctgaccgcctgggtccgcgagcagagccccgggccgggtgcgcgctgcaccaacgtcatcgcgggcgactttgtgggcgcggacagcttcatcagcgacgtcatccggctcaacgagaagctgctcccgtgctgaccgtgtccttcccccagctcgtcaagcgtgtgccaccaagattcgcccttcattctcctttccacggctgtttgggctgcacacggggaggcgagtggagtctgggcagccggggccagtccctcaacctcctcctgactcagggcgtccccacgggtggcgcctggcctcactgtccttcggcctgtatttggggtggattccatgaacatgctgatgattggagctgaccacgcggccgtcctcagggaggaacgactgggatttggggtcagttctcccaggtccagtctggctgggcccccgcgagaggctccgaggcgccctcccctggggctttgcaagcagcagaacgaggtcccggcagcttcgagggcccatttggagccctgtggcaccgcctgtgccctgtttcagctgctccaccagccctaccttggggaaggcccggcctgcctccagaccctggtgggaggccgcctgtcactcacgcgcccctgagacccagcgtctgttcctcatctggcgtgggcctctgccacaccatagtcatcccctttctccagcgaccatggggtgcagtcggtttcccggctcctccgttctcagtttcggggactttctgtctgggggcatcccgtggtcccagccatgatgacattcactgtatttcttattttccgtgttcttgactctctggtgttggggcctcgcaggcctgagagacggcccctcccagggtgagcggattcccagggatgaaagccacttgctggggtctcgcctctcagatgccagctggccccgcggtctcaaactccggtcccacaaatacctgctctcgggcacgtggcctcacagatctggcagcgcaagttgtcggccgaacgatgggccccaaccaccctccctatctcacttccctcctgagaggacaccctggactcttgtctggcttgagttccggaacattcctcctataacggaggggccctgggcattagggtttttctggggtgtgtggatgaagttggacccacatgactacccccgtcacccttgggaggggttcgcctttgtacgccaattagtcgcttttctaaaaagaaaatacacggatgctctctgccgccgcagggtgctacctgcaaggaagaggccgccggtatcacccagaaaaagcctttttgggacaaccctgccgcctgcttccgagcccggattcttctagggcgcatattggtcctacgccggcgcgttgt

SEQ ID NO: 13 - DNA, 2170 bp, Equus caballus
gggagcttttgggggctcatttcccagggaccgcccggaacagggagcggtccacgctggtccccggcgcacgaagacactgtcccgcccccttgggtctctccaaaagccctcggggtcggccccgcgggaaccaagtcccgggggctgcggggcgtccttggccgggtcacccctcctggaggaggcggcggtgctgcgcccaggggggccacccccggtccccctccagctggcggggcagacggggctgcaggacccgcgtcccaatcccgctcagggcagccaggcgctcaggcctctggggggaacgggaagtcaggcccctcatcctgtcagctctgcgcgtgggggtcccggggctgccaccagacgccacagcagtggcctcagaccacactgtcctcccccaggtctgcaggtcgcaagtggcacgcggctgtccccaggctgcagtccaggcgtcggcagggcggtgctcccggaggcagcagggcaggatctgtgcttgtcctttccggctccggggccaccacggccccgacctccgtgtgcacagccagcgcggagccacctcgggcttcctctcgtgacacctctgccgtcggaccccactgcctccccctgatgaggagcctgtgaggacgggggccacccggaccctcaggatcacctcccagctcagcatctggaactgatcagattggaagactccttctgccgttacagggtctggggacgaggacgtggacgtctttggggacattattctaccgtctacccaaactccctctccacatacggcagggttagacgccaggtagggaagcttgggaggcacaggcactgagggagcagcagtgagggagtgaggggccctgggcgtctgtaccagggtcgtataaacagagaaagttttctcccgtcctgaggaaagtgcacacacccccttcctgtgatgctcggaaggaaaggggtcgacattcttttcaatcattcctgatgctgaagtttggcaacagctcagaaaacactcacccttctaagggcgaatacaaatctaaggaagaaaattaattaaaatttttccatggggccaaaagggacacagacacccccccccccacccccattagcattctttagaaaacctacaattgtgggctctcaggtctccttgaaaccgatgcaaatctctttaaaagtcgaaggacgtcctgcgggtttggcatcccaggaatgtccctcttggggccccaggcgatgggggagggggtcctgcctcctgtctctgtgggaattttgctgcacgagttaacatcctgcttgttgcaaacacgggagaagctttgcttttcttctggataagaactaacgtgtgtgtgatggtcgcccctgcccgctcggccctgtagacaatgaggttcctcccgtctctgcatctcccagtggctgcctgtgaccgcccctcacatcctgctttcctgcctgttcgtgataaaacgtgttttcttgtctgccttggagaggcaggtgtgtgggttggtgggacgctttatttttaattatttccacgacatgacctgggggaaagcgagacctggcagctgtgcactcgcgcaacacagcagatggcgaatctcactgccctgcggcagaagcgtctgctgggcgtcagcgcgtggaagaaccagacaggcggcttacaaacccagtaacacagcttttaacatcgtgcggccggaacatcctggaagggcagtccgtccacacgcgccctgatcacggcccgcgaaagcgccgagccggcggccaccagccctgcgcggggtggggtggggggtgggtggggtggagggggcccccaggggcgctgcaggccggggaggagggggcccaagggcgcgcgctgcaggccggggaggagggggcccccaggggcgccgcaggccgaggctgagacgccgccaccccgcgcggtcactgtgggaagagcttcctgaacctgccgtaggccgagtggctcatgatgaccgtcacgtcggcggcgccggcctcggggatcacgtgcacgtcctgcaccgccgcctcctcgtgcagccagctgggggggcggggtcactcaggccggcggggcccccacagcgcgttccaggtgcccgcacccggg

SEQ ID NO: 14 - DNA, 2952 bp, Equus caballus
tcaagtgaagaaccccgtgactgggcttccaccggcatctgctgtgagttgaccctcagggcccatgtactccccacacttccttgcaggacagctggggagccccgaggtgagggagtcgttggcccccagtggctgtcggtggccggcccggcccaggaaagacagcgccaacccctggaccccatcctctagacccttggacattgggatcccccatcccctgtgctggggggcgagtcctccagccctctgtgccatggggagacagggtctgccctcgtctgggctgaggggaggcacaatcttctggagtttgagtcctgatgggtcccgtgggtcttccccacgtccgccctcgtggtcgctcggatgggcccttgggctcatccctgacttccctcgttcatctccacgcgcggcccatcgacaaaccctgctgtctttcccgacctgcccggcccgtccccagctccccgctgggtctctgcgaagcctccctgctcctttgggcccctcccacagccacctgccccgaaggctcgtcaaacgccacacggggccccaccctgtcacccccgggtatccactatttggaaaatgaaaactgagatgcacttgcgaagttcccagcccagcggctcaggtcactgcaaggctgagacctcccacagcacgacagggcgcttccctccccgacctccacagcacgaggcctcgtcaccacagttccttctactggtacctcacgcccggcatccagaaaaaattactgtgcctacaaatagacaaaaaaacacagcgtgcacacagagcaagcgtcagaaccagactcggacgtggcggggatgtcggaatcatcggcctgggaatttagaacaactgtggttaacatgctaagggctctgatggataaagtaggcagcgtggaagaacagacgggatatgggagcagagagatggaaatcctaggaaagaaccaggagaaaagctagacgttgaacacactgcagcagaaatggagcttggctttgacggggctgaggaaggatctgtgagctcgaggacacggcagcagcaaaaactaaatgcttctgtctgcagaagatgctgccaagagagtgggaggtcagccctcagactgggagaagatatctgcagatgcatctgggaaaggactgtcatcccaaacatacaaagaactctgaaaactcaacaataagaaaacaactggattgaaaaatgggccaaagactcagacaagcacctcaccaaagacatacaggtggcaaataagcatataaaagatgccgcacatcatagtcatcagggaaacgcaaacgaaaacaacgagattccaccgcacgcctatgagaatggccgaaatgcaggacactgacgacaccagatgctgacgaggaggtggagccacaagaaccctcattcgtggctggtgggcacgcagaacggtgcagccgctcgggaaggcagctggacatcttcttacaaaagtaaacccactctcaccatacgagcagctggtatttacccgaatgaactgaaaccttctgtccacacaaaaacctgcagggggatgcttacagcagctcggaagcatccaaggtgtccttcagtggggagtggataaactgcggtgccgccagacaacggaatgttatcagcactaaaaagaaaagagctgtgaaccatgaaaagacgtggaggaacttaaatgcatgttactaagtggaagaagccagtctgacaaggcgacacagcatatggctgtaactctgtgacattctggaaaacggcaaagctgcggggacagcaaagatccacggctgccaggggtcggggaaggatgaataggagcacggaggatttttagggcactgaaagtactctgtatggtacagtgacagtggatgcatgtgttacacatttgtccaaacctgcagaacgtacaacaccaagagtgaaccctaagggagaccatggactttgggcgacaatgatgtgtcaacgcaggtgcagcagttgtgacaaatgtaccatctagtggagaacactgataacgggagaggctgtcagagtgtggggcagaagggatatgggaaatgtctaccttcccctcaattttgctctgaaactaaaactgctcttaaaaaagtctgcaagaaaaaaaagaaggaagcagtgacacacaatacaacgtggatgaacctccaaaacgtgatgctcagggatggaagccggacacaaagaccacatattgccagcttgcacttgggtgaaatgtccagcagattcacagggacagaaagcgatcaggggctgccaggggcggggtgggggagcggtggggagggactgccattgagggcacagggtctcctggagagtggaaaacgctccggaactaggtaggggtggtggctgcacagcactgtgcacccttcagaatgggtaacttgatgccatgtgaaccacagctcaataaagctctaacagaaaggagacgaggaaaagaataaaaagaagcccatccgatctggtcactgtcctgctcaaaacccagtgtgcttgtggaagccaagtccttacacggcctactcgaacaggagtgacccggctctcggccccctgggagtggtcccgggcgcccccagacatgctcccccgaggacccctctctgcatagggcccctagccgcctgtgtgtggctccctccacctcggggtcccaccctcctccaccgtgcaggaccatcctgccaagacggcccggcctcctggccactgtccgctcggcctgtccccaggcttaggcccgggcgggcgcttctgcgggggtcccggtgggttgtccccgcctgggggaaggacgggtgacgaatgtcaccgctgctcagggcggcggcccaggctgtgcagtttcctcggggtttg

SEQ ID NO: 15 - DNA, 1394 bp, Equus caballus
ggagctcggccagcgccaactgcagccgggccttcagtggtccgcgcgttgcagcgaaaaatgtgcagaaccaccgtgatccggtcaaacaccggcacaccccaggcggcttccagttccttctggaaaaggagagtgagcgagtgagtgggcaggggttctgcgacaggaccccaggctgggcggacgtggtcctgtgtcctcatgtccctcctggtgggatgttgacccgcccgcctggccccccaggagcccgggtacctgggtgggcgcactcatcctctccacgttgaggaagacggcggtgacctcgggcgaccccctgattctctctgaggggaagagatggtctcgtcacaggtctgtgaccccagcacgtctgttgcgggacgggggctgcacgcgctggctgtgctcacgggacatcccggactcagagcatcgtatgtgggatgtcgggaggcggctgaggggtcgatggggtctgtcttcaggggcgtgggtctctgtcacacagaggggaggacacccacccggggggactgagcgcgtctacgcccgggggaacctagacgggccatctgcaggactcgctgctcagaactgtgagccgagggcagtttggggtggggatggtcagggtccagaggtcagggttcacggcagggcactgagcggctggcgagcagcctagagaggggaggttggggctgggggcggcagggtggctcccaccctaaactgtgtggacagcaccctcagggtctccctgacgttctgatcccagtggcagcttttcccgagttcccgtgaggccgcctgcacccggccctgacagcaccccgccgtggctgcgatccccggggagaagaggggacagggggcccggggcacgtgcgtggggcccacccgtcagctgctccaggttccctttgccgaacacgagcttcttgtcgggcgtcctggtgggcaccaccatcgtctccaccaccgaccagttgtccagtgtgtgcaccagcgcccttgcctccgccacctgccactcggctgtgggggagagacgggaccgtgagagagacgcgtccctctcccaaccccaccaaacactcctggatctgctccccagaccctgacggcttcctcgacccagcgtggcaggcccactcaagaaagtactggaagcgagcaaaagactccacttctcataggacacgaattggcaggcgagtggcagtagcgggagatgttatcgtgcgaatctaggagtcggtaggttatgatgagaagtaggagtggactctttgagatgatatcatttgccctctggttccttttagtgtagattggaggtaggctggcggagtcttgtgaccagcttcttcgtcattggttcc

SEQ ID NO: 16 - DNA, 10734 bp, Equus caballus
gagtggcagttctccctctgggtgtctttagatcctcccttggggttccgaatgtggcttgtggatgtggcttgggaaatgattggcagagcccgctgggtcgagcatgtggtgagggtgggctggttccagggagcctcacccgttcagactggtcgcagtttctcctgcaggcagcatgcggagtgcccggtgctgaaggggtcacagaattccagcctccacggaggttctggttttcacgggagaaccattgtcggttcgttgaaatgttcctttctaagtgtctgcaggaggccatggcctttctgaggtttcgggaggtgaggttacatcacatcgtgtaacagaggatgagggagacgccagacgactggaaagacagaacggagccccaagcggccttggaaacccagtagcatcgagggatgtgtgtaagggatgaaagcgaccttgagacggtgcgttactggcgggatctgtcgtctacacggcctgacaaatgggatcacactgtgcagaagtagaaatggggattgagacgtagattgttagccttgaggacaatcggtgacatcttgggatcttgactcagcgttgccgccgaaagacgtggaccatcctggtgccatttgcctgtggacaggacgagactgaattcaaacttaggatgctgacttcacgagttggtgagctcgggtggtccacaccctttgtgacgatgaggccacgggaagatctggggggagaggaggaaactgaggacagatgcgcggcgcgtcggcctgggacgggtgtacgcaccgcaccatgttactgtatgtgtcgtatcgtgttgtctgtgttgctttgtaaaatgtttagcttaatgtgtcccgaatatgctgccagtcagtgtgcagctctgtatttactgcacattgtgtgtggaccgcctgcctggaatggggtccgacgggtgtttggtaactgatttcctccctctgttcgtcggccttacgtgtgtctgtggggacgtgaccgcggtgcagcgagctcactgcttcatggtcccccctcgtgcatctcacaatggaaatacacagcagcctcagtgtggtcggtgtcgctgccctggagaagcccccagaatgtggcggaattgctgatttgggccttgaacacggttgggcccctgtaagtgggcttgggggtgcgcggcccggcgggcggggggctgcagcttcctggctgagcagttctgatgtcgcaggggaggcgggtctgggcgactcgggcgggagcagtgccgcctccgtgagacgtgtgtcctgaggctgcgtccgtgcgggcgtctccctccgtcgcgtaggcccaggttttcctgctcggcgcccaggtggagccgctgtagggacttctgtgcacaagcctttgcccggaaatgggccttcgtttctcctgggtcgggaccggcagcgagtggctggagtctggaacgtgtgctttttgcgagacccccaagctgtcgtccaccctggtcacactgtttcacgctcccgtctgcggtgggagagtccagtggcctcacacgctcctgtgctcgtcagccttgttggttttagccgttgtgatagtcaggaagtggtgtttgctgtggttttaatcccgtttctctgatgctgagcatctttggatccatatgtatgctttcgtgaggagtgtgttgcaatcttttgctggtctttttttttttttcttgctgaggaagactggccctgagctaccatcggtgcccaccttcctccagtttatatgtgggacgcctgccacagcatggcttcacaagcggtgccgcgtccacacccaggatccgaacctgcgaaccccaggccaaggccgtcaaagaggaatgtgtgaacttaaccgccactgggccggccgttgctggtcatttttattgatttgcttgtcttctttctgttgagttttgagccttgttttataaagtcttgataaagctccttcactggacgtgtcctttgcacgtatttttctatcagacggtgccttgtcttttcatttcctcaaacaatgtgttttctggagcaaaagttttgaattttgatgaactccgatgtatctgctcttttatggatgatgctttttgtgatcaatcaaaacattttaaccctacgttgcagaattttcctcctatgtttgttctgaaagtttcgtggtttccatctcagcgttaggtccgtgcctcgtgtggagtgaaccctcgtgtcaggtgtgcaggggaccgagacacggcctgtaccacgtgggtccttctggccgggctgcgggttaaacggacatgagaccgactaagaggagaaagtggatcaaggttcaccacagtggacgtgcggagacccgggaagcctgagcgacgcccagatggcgcaggctcttttcttaaatcgtcggccggagacaaggagggtgtgggagggccgaggcttcgcggggagacaggcgactcacggggacgtggaacagcgagtgtttggggaacaggacggtgataacagggctcagcagggacccgcccagcctgccggtgcccggagtcgcctgtgggatgcctgtgcctgggacggccttcatcttcccttcctcgcgtcccctccgtcctcagacccagggcccctctctacccacggggctccctgtctccctggggtctccttggggtctcttctggcccctccttggcccccgccccccacgcaccctgcggcgcgacccccggggtcaggacacccctcctcgcggggtctctggtgatgctgggcccttgcagctggtgcctggaagtcgcgtggaacagcccgtgtgcgacgtggaagccgtgaggacgcggctgccccggctcttttgtctccttccccggatcgtccgggtctcctcagcagcggcgtggtttccacatctgggattccccgcgaggccgtgcgcgtcatcccgcctggcgtgagaggagcgtggagcagatccagccagcgagtgggaggatgcgccccgctcgcccccgtggacgcgagggtgccgtgcggggcggccgtcttgtcttatgcctgggatcaggcgcagggacccctggtggggccgggaggccggcggagggggcactgactgagccccgcctgccctgcccgcgggcccttcacgtgctcgcgatcacacacacgtgctccctgctggtgccgtgcacacacgtggccaccacgccctcctctccccggggctgtgggcagcgtggtgtctgcagggcccgtgaggctcatcttcagcctccactcagagcctcccaggtcgatgcccggcgtgagggaggtgacttctcagcagccgtgtggacgggccggagtccgcgtgagtcccggagccgtgagcggagagggcgggtgtggttcagccatgaacagcgactgaggccgacacgtggccgtggcacggatggtcccagcacacggtgctcgggggtggaaggcgcacacgaggacacacggcgtcgaggccactgatgggagaacgagagcaggcggatccgccgagatatcacgtggggcctggatggggagtgaggctgcaggcaggtgtgggtgatggaaggttctggaacgggtggaggtggccccactctgaacgctcctggggaagggcctttgcacggggtgggaagaccccttttcataaaaaaattacagactgtaatggttattacagggtgtgttgtacacgtgtaacgaatccgtataacgtgggatcacgtagccgccatccgaatcaagacaggacgtgactcgggagcccccgcgagcccttcccatgaggccccatgtgtgtgaccgtcgtgtcctcatcctcgtggcccccgccacgtgcagccttcagtccctcagctctgacctgctgtggaagactcaggtttggctcctcgtggctgcggtgtccccgtccacgccattaaacggagtccccacccccctctctcagacctggctccacgtctactttctgtttctatgcatctgactcctctgtgacctcctgtgagtggagtcacacagtatctgtccgtctgtgtcggctgacgtcactgagcatcttgtcgtcaagacccattcatgatgtaccaggtacagagtttccttccttttcagggctgcgtaatattccattgtggggatggactgcgttttgtttcttcatccattgatggcagatgtaggatctacagtaatttctcatgtctcacaatatgtgtggaacatcttcagaaagtcctatgagtcaaaagtcgtttaccattaacgtttttcacttgttattttgaaaaacattgcacctgagaaaaagggaaaaatacgtagaactttgccctgcgttccctgtgttccctgtgcacgtgtgtgtgcatgtgcccgtgtgtgctgtgcatgtgctggcacacacgtgtgcacggtgcatgcggtgtgtttccatgtgcatgtgttggtgcatgcgtgtacctgtgtggtcgcaggcgcacttgcgagtgggctgcagactgaatccggctctagaaatgcgtgcgtgcgtggtccacaggtgacccttagcagccacgtcaccgccgtcgatcgcgggcactgggctggatggcgtggacgtcctcacggggcctgtgctcacggctgcatcacagcttctctgagccccactcagtgtcggccgaggaccccgtgacgtttagccgtcctgtcctgggtcccttcaggctgcaggcttggccgtttggagaccccaggcctgtggttgtggggacaccgacgtgggggtggggtgtgggcggcacccaaagccccaggccgtgcggctcccctgcccactcccaccttggacgcctcctccaggagcccaggatgcgcctggggtgcagggatgaggggagtcaccccactgctcgtgcgtccctgcaggagacaggcctggaccacaggaaaggcccggccgagcgggatgctgacacggacgcgcccgagacagcgaggacgtcacctgtgggatttcgggagctaaaaacaacgggacggtgtggatgtgcctgacgcaggagaagcatggacgctgatttactgtcaggaagtggacgacctcgtgcacaagggtgagctccccgtgcagggatgagggtcacagagctgacgcggcccccactctctcatcacgtcccctcactcacagctggtgttggttgctgctctggtggtcgtgctgcccgcacgctgggcctgtgcctgtggcgggaggtgtggctgttggtggcgtgtgagtgtctctgggcgggtcccatgtgaggttctagggtgtcgggacgtctcagcaggactcacatgctgactgagtgcgtctgggcgccatcgtttctgttgcatggagctttgacaaaccgtcctcctggggaccccctctggtctctggggacacaggccgcgttctgtggtcctgagtgttcccgctgggcgtgtgctggtgctcctacccctgggcgtgaatagatgtggggtcacaagcgtgctgcatggtccccggggtgcccaggaagcacagcctcacccgggcagcgcttgtctacgtggtcctggtcggcagacggttcctgtgaagggctggttgtgatcattttcatgccgtcaggtcatcctgtccgtgtgttagtgtgagaccagcacacacgtcacgtgacccagtgggctgtgtccccatgaaacttcattgacacacgcggttccaataaaactttattgacaccagcccttccaataaacttcactgacacaggtgttccaataaagctttattgacacatgcggttttgataaagctttattgacacacgtggtttcgataaaactttattgacacaggccgttccaataaaactttattggcagaggcggttgagggcgagaggcctgagggcggggctgccagccctgatccgggccctttccttgtgaggagccgcttgtccctgaaggactgggtcccgtctcgcttcccccgacccaggtgccaccgtcagtctggggtctgagaggccggcatcgcggttccccgcccgccttctccgcccaaagtggagaccccttcgtggggcgggtgcccctggggaggcgcgaggtgcagggacgggggacatgcgtgcaggcggcgggtctgcacgtgactgtttcccttcctcgccggccgcgtgcacagggcgtcctctggccccgtcatggcaaacgtccgtctcctgcagaggccgagcgcggctctggctcctgtgcccgtcttccagggccgccctctggaaagagggaggacacagcgcgggcggggacgcaggccggtgtcccagggaggacgggccgccaggaaggtgtcgccttgctgaccgcgccctccgctgtctgcgcgctgtgcaggaaccaggcctgttccgggacgcggggagatggtgcgggtctgcccccggctgtggagacgggccgcctcctctgggtgagccgggcacgcggaggccgcctcggggtcacacacgagccccaagcacagggctgtcgtcctccctcggacacccatccccgtctctggtcctggtgaggggaggccaggagggcccggaggtcaagggacagcccgtgggtgtggggggggccctggggcacctggcagcccgttgccccctccgagcagcccgtctggggccagagccgtgtcctctggagctgggaccgaggcctcggccagtcaggcactgggcgtgtgcgctggagggagccccacctgggcccgcctgggggcgggtgagccctcggttccaggacctgtcgggcagtgtcagcgggctcgcccgggggacgtcgagcgcccactgagcccgtgcacctgaacgaagcgttgaccccctgactcaatgtgtgtgtgtgtgtctgtgtctgtgtgtgtgtgtgtgtgtgtgtgtgtttctggtcagtgcgcacgccctgcgccccctggaacctgtgtgagaagatggacagcctgctgaccttccagtggcaccagggcagcctgcccaccgaggtgagggtggtggggagggccctggggggtcagaggtggggatggtgctgggggagggggtcaggtggggaaggtccccagggcgggtcccccgtccatccccgaccccgggacagccccgtgtcctgcaggtggtgcactgtgcgctccagtgtgcctactgtgcactcctctggcagatcgtggcggccacacagccgctgctgccccaggtggcgggggacctggtggaggtcagttctagatgtggggtctggaggggacacgagaaggacaggggtggtgtccgcgttttgaccggcaacttgtcccccctgttggcaggcgtccgtcatcctgggggccggcctgggctcgttggctctcacaggagggctgacttgggccatcgcccatactgccacgtggccggtccaccgatcgtgtggggtgagattcaaataatctctgagcgcctgcccccgccccgccccgagcgctccctggtctggtgacagttctgtggggtggcagtgtggacctccgagggtctggtcctggagtctcgtttgttattgtttgacgtcccagctgtcgggctcggtcaggagctggtgggaggagcagcctccgcgtgtccctcagggtctcaggaaacagacgcgcagaacacggccgtcgggagattgatttggaggtttggctcgctggcctgtgggctgggtgtcggaaatccgagggcagccgggtctcgggcgggtttctctgtcctggtctggaggcagaatctcgtcccgagacctcagtctctgctgtttggccctcacttgattggacgaggcccaccctcattactgaggtcatctccctgacctcgggtccgctggctgcaggttaacctcgtgcacacggcaccttcacagcagccgccacgtgagccccgggcaccgtagcctgtcggcatgagcacacaggactgacccgctcactccccacacgccctttgtccttagagggtgtgttttgtcacgtctggcctgaggcagccctggagctgcaccctgctgtgctgggacctggcgtctgggtggcgcccatggcacaacacgggtttgcggtcagtttgtccatccaccatcgccttccggccagaccaacttctacccacgttcaccgacgggagaaccgagctctgtcgcatcagggactcgcccaggtctgtggcctggtggggccccgggtcccaagcccatggcgcggctgttgggatggcctccctcaccgcctccgtcatcgcatggcccgtgtgtgttggacagatggccgggcagagccagtgcaggcgggcgggtacatcacgcacatgctaacctctgaggcggtgcctgcgctcccgctgacggggctcctgggcttcagggagaggctgctcaaggcctgacctggctgccgcatgggcctgaaccaccagagtggggcgctgagcgagagggggtctgtcacgctctctgtcctggccgggccgtccccagggtcagaggagcaagaggcgggaaggtgaaagtgccccgtgcgtgggaaagtcggggtgtgtggtgttttacgtgacggcgtctacacatcttacacgggtgtcagacgacggcgtctttccccgaacgctgagaaggaattgtgtgaacgtcccatttgcacagccacagcccaccctttagacgtctgtggggttgatggacacgctcagagttcatgctggaactcggctggttgttcccgtggatgaaatgttgacgggtcaatctcgtgccagggatgaagctttttttttttatttttgaggaagattagccctgagctaacatctgctgccaatcctcctctttttgctgaggaagactggccctgagctaagatcatgtccatcttcctctactttatatgtgggacatctaccacagcatggcgtgccaagtggtgccatgtccacactcgggatccgaaccagtgaatcccaggccaccaaagcagaacgtgcaaacttaaccgctgtaccaccgggcgggccctggaatgaagctgttctgagcgctttgcggctcggggcgagtcactcagttttctgccgtcctccatgcaccatgaggagctgctgctttgcacagcaaattgggcgtcaatttaaaaaggagcttttaccaatatcttagagaaaaaatgtctcatttggtggatgtttgattactagggggtcaagggtttgggcattttctctgggatcgcctgttatgcgtgtgctttggtccttttttgttcgtttgtacgtttctggttcacagccacagtgccggcctctctcctgcagacgtttccccagttcatcgtttgtatgttgtgtttgttgtttgcacatcgtatgcatgtgtgtttgtatgtttgcgtgttgtatgtatgttgtgtgtttgcatcttgtggcaacttaaaaagcaaatttgcccgttattttatctcaaaatgagtctgttcaggaatagaccaaagaattgcaactcaggacgtgcgtgctgtggagaaccacaggcaaatccagagaacgggggagctgcctttacagagaaagggggagggcggggccgctctgaagaaagggccatccgaagagggacggaccagggcgggaacggctccgcattggctcagctgtttctgattggctgagctggttctcgttgagctgtagtgtttctgattggctgagttgcagtgtcactcattggctgagctgtttctcattggctgagctgcggcacttctgattcgctgggctatgccggttttcattggctgggctgtggtgtttctgattggttgagctgtttgtccttggcttagctgcggcatcgctgattggctgggctgttgccgggtggggagagcatcttccctccatgccgcagcggtacttcccattggagacgcgagcccggatgtcttcctgtctggggtgattgacaggggagggcgtgaggccccccccccccccccccaccacaggacggccccgtccagctcagctcaggtttttttagtcacttttgcagttgtggggggtgtgcgcacatacatgttgctgtgtttgcgtgccattgggcccgtcacctccgggcccggggttgcatagaaaggccttcgaagtctgtaaatttgccccatggttctcttgcccttccctacttgtggaaagcctgggggggctggtccactgggtcctagggggatggcgggggaaggggcgggattctacctctaatgaaggaaggaaggtcatcattggcctccggcctgttcttctgttcttgtgaccgtttctggtccttaggtgctaggacctgccatgagactgaagaaacaaatgtgcaccttccttaaggaagacatcatccttaactaagtagatctatcatctgtgctttatgcagaggtgctccctgatagtcaggccggcttggctcgtgagagtgatcgtccctcgagcaggtgggtgtccgcccctagagatctaagatgcctgcgtatgtgtataacgagtgtgtgagctggtataagaatattgatgaaagattattagagatgtgg

SEQ ID NO: 17 - DNA, 3660 bp, Equus caballus
gctctgtgttgttgaggaaaacatcgccccttcacagctcatccggattctattgtagttaacagctccctcccatgcctatctactggtatgtgttcccgccagcaaacacgttttgtgatctgagccttctcctcaggtggagagggccattgcttcggtttcgttctctcattactactgagattgtatggaagctccatgaggacagggacggggttttggggggtctgattggatcgttgtttaggggcagtgcctggtgatgacaaggagctggaaaaggtttgaatggatccgggggtgggaggaagggggagggagggatggatggacgagtgggtatgtgggtggacagggggatggatgggtgggtgggtggtgggtgggtaaatgggtggatgatggatgggtcgagtggtgggtagatgggtagatggttggacagacgagtggacagacatgtctgtcagtcagtgtcactttccctccaggactgtgcaggtgtagactcttggtgtgtctgtaacacggtggcgactttagccctttatctgttgcgaggactttccctggattccttttaattgagagcttttatttctatggtgggctcttctttctttaccttttttaaccgtaaccctccagtctcccctggttttttcctgcgcctcgcgctcctcgggttggtctcctcccggcccacgaccaccttgtaaaccagtgtgggctgagcccccatgcatcctggaggctgcgccggggcgccctcttgttgctgacacgcggccgtgcgcccacgggctggctcaggcctggaacgggacggtcagcgcggctgtgaggggtgttgctccctcactcctcatcattccccaggtcgagggcccgatgcagcggccatgagctgggcccgctctgaaggtgcactcactccaagggctcggggaccggctcccccgtgggctgtcgcaggcaccccacttgctgcggtagccgtccgtccgtccgtctgtctgacttacagcctccccgttgtttctgcgacgccatccaggacaccgcgaggaggatgaggcagaaggacaggccccagaacgtgctgtgcccgcgcctccacctgccgcaggtgagcgggctgttccggaaggttggccgctgccccacgggacggagctgcctggcctgcagggtggcgggcgtcaccgggactcacccgggtccggctgttcctcttccttcttaggaagcgtcaccgcattagcggttggtctgcagtcgctcgtgacaacagcgcgtcctggcgtcttggttctggcggccgtaacgaaggaccgtaatcggggcggcttaaacatcagattactttattttactttatttattttatttttattgtctttatttcccccagttccgggttctctttggggtcaccgatggcccctcctcgctgtgtgctcgcagcagagacgggaggcagctctgtgactcttgttaggacctgaccccatcgcgggacctccgccctcctgacctcgtctgaccccgctgacctcccacagctcctaaggccatcacgcgggggtcatgtgccctggtctcctggccggatgggggtctcgcccccattggcctggccgggagcggccgtgcttctgtgtgggctcgatagtaccccgtggggcggcttttctagctgagcccggggacgttcctgccctctgagctgcacggacccaggggactcgcgcgcgtgctgtacggggcggggcgtcctacgcagctgcagggtgtctgcccacgtcggagacaggcgtccctaaccccatgtgtgtgcgcgcaggttcccacaccctctctgttctgtgtttgaactgcagacgatccacagacccccccccccgtgctcctgaccggggcccgtcctgtcatagggagccccctgggtaccggtgtggactccacgtgtgtccctgtgtggggacgtcgggactcgtgctgcccagcagtgacttgagggtgtctctctccccgtgtctcagggcggacgtttccagaaggagattgtacagaatcctcacgggagacagtttaccccgatacgtgggctccacggctgtgatgtgtggaatccacagccgtgaggcgtggcctgtgttctgctctgcatctcggtgccgccttgttccgtctcccagacccatctgtctggctttcatgtcacgaggggtcacctagaggtgtcaggagatgcccctcgtgttgagaaaggcgccatgttgacttaggcgcccgagtggtcccagaacctcatcgtcttagaggagacgccgccgtcccttcctcaccatcctcctggcttggtcgcctggccggggcgcacagtgtgtctacggtctctgggagcactgagcgtggcgtcccgggtcggcacctccatcctgcaggatcctgtggtgcctacagggcgaggtgaccgggcctttcccaggacacttgtcggcctcggcctcacagttctgccagaactggcggttgtcctgtcccgtttctggagggtcatgcagattcttttgtctacactgaggtctccctttagacttaattttttcctgcactttgttcctcagggggaagagcatcttgtttctccttgtagacgtcgtctgcacataaaacgttcagaccaaccgaaagttccccacgtccagcgctggtggacgcgccaggctccctgcggcctgttccgtgcgtgctttcctcgcttggggaatcgtgagcatcttccctcgtcggcagcgtgctgttgggttcgtcgtctcggaggccgtcggagctcttgctgagcagatggaacacgggtggtgtcggtgtccccccgcaggggccgtggggcagcgtgcgggtccccacatctccaccgtctgttatctgcgtcctgcgggtcagcggtctgtgcccccgtgagaatcgcctcggcctcaggtcggctgtccggaggagcctggcacctctgcttctgcctgggctggcgtgtggccttctccttgagcagaagactgactggtttctgggatcccgtcatttatttctgcttttcatctttgcggagggccagggggcagttttggaggcaggccgagattcttctgggttcttttctggattctcttgaacctgggtcgcctgcggaggggatggggaggctgcccacgtgtcctgggttcacagcctgatccagaggccccggggcttccctgaagtagtcgggggtgtgggcaaggtcccggccctccgcaggtgcggcccaccctgggcagagacgcgcggtgtgcacgcctgtggtgggggggctgctgcagcaccggttttccagcgtctgtggggtccgttgggggagcagccctcgcccccgcccccacccccgcccccttcacctgggagggggcgtcaacgcgcagacacggatgcccagactccgggacacgggggcgccaccccctgctcacttccggaaacgcggagcaaccgggccaccccccagacccgaggcccagggtgccccccaggcgagatcgccccgaaccgtggacccccaggttccgacagcccccttccttcttccgctgtttccaaaagcacgtggatacgcac

SEQ ID NO: 18 - DNA, 41161 bp, Equus caballus
ccaccaagacctggtgggcctggagctcctggtcgcgcagcccctggcagaggggacaagtggggtcggagggacattgttgcacacgggcctcgtccttgagggcgatagcccgtccagcctgctgcttgggtctgaggggtatgtgagggttggtctttgaggctgtagaaaccggcttgtagagccctgcattcctcacccaagatggctccctcttctctctctcagcccaatctgaccccgccggtgacctctctgcccggtcctccctgggctgccaccgcccctacttcctgtcactttctcgtacgtgcatgttctcgctgcccatgtctctgtcgctcatgtctgaccaggggacggatggggggaccctgggtgggctcctgggggtctctggttcctgcctgggtctcaggtctgtcccctccttgcacacgtccctaggctgtcccctccccacccgtatccccaggtccaccccctccttcttacgtctggtatcccctctcacccacagactcgcccacttccaggactccatctccgaggacatgccagccttctgggaagggaacgtgaacccctgctcatctacctcggggccctcatgaggacgaacgacgtggccctgggggaggaggaacccgctgccaatccgtttgacaccagatgcaaagacagcaagcatcctcgaggtggggggtgtccccagggtggggagtgtcctgggatcaagggggaggttcattctcaaggtcggggaggggccccagcgtgccctcacggctgaccgctcctggctctgcagagctgcctgtgggaaggtgctccccctggacaccagacaccctggccagctccactgcagccgacagagacccaaggaacccgtccaggggctgcaaggccaagaggtgcggccatctcctgtgtgtcgggtgcagggtctgtgcttggggacagcttgtccagaacctgccggcctgtctctgcatcatcagcctcgagggtttttccaagcatttctcaaggagtggagctttggggtggccgcagtcccaaagtcgggctagctgtttggggacactggtcagaccgggtcctgcctgggtctgggacaggggaggacgtgcagggacagtgctgtcctggcggaatgtgctcgagggggcagcaaggggcacttcccacctcccctgactgcctgaggctcaacagaggggacacggcggagtgtcagatgccactgggtgtccacaccctgggggctctgcctcctttgtctcttcctctgtccctctctgtgtcctcctccatcagactccatcttttctttcgtttttccacgactgtccaggcttgtcgcctccagggctcctgctcccacctggtctcctgcctcagtctctcaacagggatcgaggtttgagaggaggctgctgggggcgtgtcctgccgctgggttgctggcagccgagagtggaggactgactcgccaccctctgtcacctgcagggacacctctgatgtcaacgtcctgtccttcgaggactccgagaactcttctaatgaagacattgatgtgcgtgtctctacccagggggtacgtcccgggcggggcctctgggtggtggccacatggggcattgacggggctagagaggatgctgactgggcgcagaccgggcgccacatgggggctgccttctcctgcccctgcccccaggccgcaggtcagggagaagcgggacacctcatctgagggggcctcccagtgacatggcggcctctgtgcccagggtggggggcgggagcagagtcctttgcacattcagtcaaacggattcgggtcctggtgggagtgactcggggctccctgtgggggcggaacacccaggtgcctgccttgtgatgatcacctgggggctggcctgactgtctgggggccccaggctcgtgcggggtcctcagctgcccaaggctggtggggtgtgggtcccgtgccgcgcctctgtggctcaggacactggttttcggggggccctggggtcctcgctggctctcctggctgaccccatcccccgccatgcctgggctgagctggggctgccggctgggcctgggtgagagctgcgggtctggggtggcccttggagaggtgcagacactcctggaaggacacccccgtgcggacacctgggtggtcagcacaccgacccagggacttggggtcaggcgtgtggaaggtcccgcggggtcagtgttgcccccggcccttcgcacctgtgtcctcaagcccccagaggccgtggcaggtgtgggcccccgtctggctcctcgacatttgctgctccccgagaattcccaggtccctcctgaattgactgggaagcgccctggagggtgccaggccgtcccgtgtgtccgtctgtccctgcgcccatccactgggtcctgagcgctgtcccttctgtccccagggggtgtctgactgcagacgactcacaccccgggtgggactcaggttgagttcctcctttgtggccacgttctgcgtccacggctggcggtcctgggccgcggcctctgtgggtgacctgggtcctcggggcctccgggctgtgaggtgcatgacggtgaccctgccgtctgctcctgtggagccagcaccccgtgcacagggcagggccacaggaccgtcgaccctcggggtgcccacctgcccagatgcctgcctgcccacggcttcctcgcggggctccggctgcccgctgccctcggctcagctgggaggaaggttccggaaccactctgctcctctctgcagagtgtggtgccacctccctcaccccgcatggtcctgctccgtgtgggccaccggctcctcctctcacggcccagggccctgttgccgagcgttgtgtcgtgtccagcgccgtgggcccagctggggggcaggagggactcgcccgcggcctggtcagtgcctggacgctttagacgggctgcgcctgactggggtggtggtgggaggggccgaggctgcagcccaggggaggaggcccgtggggttgtccctggaggcccactcgttggcagccctgcccacggacacctggggtggggccgctcgcgccctctggatctcatgttggtgccaaaccacggccagcgcccacccgaacgccagaggggacaaccccttgaggccaacctgagagcagatggggagaccggacgtcggggtggcgagggtgtgtggggggggtgtctctttttctgtctgcaggggcggattcccctctctgttgtgtgcagacgagcacggacccatgagaaccggtctgcacgtccctgcgtggccgtggctgggggctcaaggtcgcggccccggaacagccctgccccccacacgaggctgagttccacggggtctctctgcacacggtgggccgggttgcggcctcgggcggagtgtctatgctgtggggtcgtgtcctttcccaggactctgggggccgactagggaggaaccacccctggggtggggtcggggtcaccaggaggtcagaggagggtcaggctgctgggagttctcaggcccctgacccacacctgagcccgcgggttgtccctacctggtagtgtagccgtgtctcccttggtggtgctgccgtctgtccccagtggcgtcaccgtgccctgtgaacgtggtgtcgcgggctgggcgagctgaggctgtggctgaaaatctttaaattctttatttcaaaatacaaacgtgacctcataaaacatttttaaaccgctctgcactgcaaataagagttaactttacacattttgtacatttacaacaggaaaacgatcaacaaacccgagtgggcgctccctcccgcaccccgcggggagggctgtgctgggccgctcgtgtggatggaaggttccggggctgccgcggcgccgggctcctggaacgcgctggctcctggagaagaaccgcgcacggccgcccggcgcccggaagtccacgcgtgccacgcggccctgaggcaggtcctttgggagcggaaacgggatcccctgcgggatgcaccactggccaggcccgcggtacgtgtcgaatgctgggtctctgcagctggagaggggccgtccgattcccacggaggcccgagagcgcttgtccccgccgggcccggccagggggtcctgggcggtgcgtcctcctggacgggtggggccacgcgctccagggtccgtgtctgagcagcttctgtgtcgaataaataaggattcgccgttccgtacaaacgcacttcacctgtggaagacggctcagcagccaaacggccctgttgtctctccacatgaaagccgctgcgtgcagcaggccgccacggacggtgcccggggggcgcgggtcacgagggctgcaggtgggcgtccccacactcgtactcgtacagctcgacggcgcccagcgcggacggcgcctcgaagaagggcctctgggccagtggagaccgcagggcgcacagcttctggtccacggggctgagctcggcttcgtacctgcaaggagggctccgtgaggacacgcgaggggccgggcgcggcggcccagggcccaccgttctccgaggccggcgtcacctcaaacccaaaacaagactcgtgtcaccagacaccacaagtagcctttgcagacggaggccaggaacatacgggcggggagcgtatcgggaccacgcgggtttgtctcgggaaggccaggctggctcgaccaccgagggtgtctcacggcgcccgatccccaggccacggcagagacggccttggagcggcagcgtctgacgcaacgcggagcctcagcaacctgaggggacgggagcttcctcccgctgaccagggacgcgctccccacaccccacagcccacgtcacgcttcctggggaaggaggacctcgccccggggacgaggtgaggacgctgccctcacgtccgtccagcatcgtcctgacgttgcaggaagagcgacaagcaacacagaccaggggacaaacagacgggggtcacggtgtcgactgtcaccgtccagagacccagcgccgtccatcaacgtccccgcgggaccgtccgtgcgacgccacaggctgacccgacagcgcacaggaaggcgggcagactcgagtgaccggaaactctgcaccagacgaagctggagctggaggcctcgcgctccgggactcgacccccctgaggctgcagcgcacagacgtctcctgagacaccaggtccgcagaatgagcagacgccaagaactgggacaaaccacgtacctgagaaaggagctgtatccagaagccgtaaagaaccctgaagactcgataatgagacaataatcccaaacggaggagcaaggcatacaggacttcatcaacaaaggcgtggagggagggcccacgaggacgtgaacaattcaaaccacgttgcgacaccaacaagacgcgccaaccgccccggcctgggcgaggacgtgggacgggggaccctgcccatcgcgggtgtggacgcagcgggacggcttcccgtccaggtcaacgtgcatccgccccgcgacccggaacctcccacgaccacgtatcgagccaagagaatgaaaactgacacacacacggggaggcccgcgggagagcgttgtacggtggctttgcgctcattttcctagaactggacgcgatgggaaccacccagacggccatcgcccggtggctcaggacagcgcggtcacctgaaccgtgaacagcgctcagcactcgtgaaacagactgctgacggcccagcgacacgcgtgggtctgaaatgccgggtgaaggccaggccgagaggaggcggcctcccgggtctggaaaaggggaaactggaccagcacgggggccacgggccgggggtcactcagcgtgaaggacgtgctcaccctcctgcccgtgttgaaacccccgggcggggcgtggggtctgaggacccccgagccagcagcgcggctgtcacccctgggacgccgccccctgaggcgggtggtggctccaagcacacgtgggaacacgcctgaccctggcaccgagcaggcctgagggggcgtgggcgatgggaacacgcgtgtgcgtctggttgagcccctcagggcagagcctgaccctgcccgcctgtcgggcccacgccagccgcggggggagacggaaatgcgccagatgccggtctgccccgtcgtcggcctgacacgcagaaaccaaaccacaaccacgtccccagggggagtgactccatgagggccctcgggccccgttcccaacgtccaggatcctggccctctggtgtctgtggccccccgagccccttgctgggtccccgccccaccgtccgggacaccgccaggccctccgcggtgctggggacagggagcgactcaggaggaaaactgcccgggctcccggtggagaccgagggtcgggccagagtgcgtgggagcagaggggcctgggcccgtgggggtgcagggtctgcacagggggtcgaggagacggccggctctgggccgccagccctggggacccccgcaccccgtcctggcaccacctgctcgggccctgcaggccggcgctcggggaaggtgcagacgcagcagcagcagaacacaaaccaggcccggctgcgctgccgccccggggcctggactcaggactgaggccctgcacgctgcgctccatggcccacgaccccgagggaagcccggtgggcctccaggcctcctgtggggccgcgtgtgcgggtaacaggccacgggccgccgcgtgtccacccggcacagatgcgaaggctcgggctgtggcttcgggcggacgtgaggttcctctaagagcctgagagtcgcctcgtgcgctcaggacgcccagcaccgtcttcgcggccctttctcgcatcccacacactcgtcacccgagtgtcacaggcgcccccgggaagcggggcagctgtctgtggcctgggccctttccgaggggctttgagtccactggacacaggaaggaggcgcccgctgcccaccggccatccctgggccccgcgtccccacactcacccgtcctcccacggctcccccgcggcctcctcggccaccaggatgtcgtactcctcggcagcgtacttctcccagtctgagagctcggggccttcgctctcgctctcctggaggacacgcgcgtgtcactcggcgaggacgcggctggaggccggccctcccgcccccgtgctgcccgccccgctcacccggagcagggagacctgctctttctgctcgtggtcgaggtacttctcgatgttgaagaacgtgtcgaagaagacgttggcgagcttgcacttcttgaggtcgtggagggtgattttccctgcggggagacgaagcgtttgaacagggaatcacccctgggcgcgccgtcgcaggcctgtgtgtgtgcgcgtgaaaacaccttgaaacacagcgcgacaccacgtttcctgacacagcttgacgcctgtgagcagcggacagaggagggggggccgggcgtgggtggaggcctggacgggattggggggcgcggtggctgcagagcacaagcaaggctggaaactctggccgccagggggcgccgcgcacccgtcactgagccgccgcggccccaggacgattctcagtcacaatccctgagccaggaccccaagccctggaaacacagccgtaggtgaggcgtccctgtgacctcggaagctgtcctgggtcccgctgtgggcctccccttagacgcagccttctcaggtgaggagggttggggggctctgctgggtcccctggctccccggtggaccacacacgcccccaggggtcccggccccgggagcagggagggcacaggcccggggctcgagctggctggggaccaggggacagaaggggcaggtgaccctcggcaccgccccacagcacgggtgctgggctaggtctccccaaagtgacaagtcacagagcacgggcagagggacgtgggcgtggggacactcaccttcctgaccctgggggatacggacgctcaccccacagaacagggcccctctcacaggtgagggctgagggggtcctcaaaaactgagggggatgaggggagaggccagacatgcccggcattctgtccacacttagcgaccggcgactggacgagggtgctgatgtcacacaggaggacacacccgccctgccctggacactgtctccagtggcacgtggtcggtaccggctgtccccaaggccctgctcacccttgtccccaactcaccgtggggatggccattccaagtgagcggcacctcacgcagagacatcgcgtcccataagggctgtcacatctcacactggggcagcctctcacacggggacgtcatgtctgtcagttgtctcatctcacacggggacgtcacttctcacagttgtttcatttcacacggggcgtcccctcacactgggatgccacctcacacaggatgccacttctcacaggagtcgtctcatctcatctcacacggggcgtccccctcacacagggacgtcacatctcacagttgtcccatttcacactggggcgccccctcacacgggggacatccccctcacactgggctgtccatccctcgcagcgggcgtccccccctcatgggctttaccttcgctctggggcttcaccaggtccagcatctggcagaggcagtcctcgaagggcagggcctcgatggccatgctgtccagcctgcggcactgctcctcgtagaagtactccagctcgaacatggacagcgccccgtccccatccaggtccatgcagcggaaccagtactcgatgctgcggtcgccgtggggcaggggggcctcggtcagcctggccgcctgggacagaccccagcaggacgaccttgcccggcgcggaccctgcccgggactgagctcgcccacatggaccgtaggaggtgccctcgctcagggaggaccagtggctgccgagcgctccccgaggcggagcacagcaccgctgcccagcacccacctggtcggggttttcttgtcttcctcagagatcaggaaccagacaaagtcggcgtagctgagcttcccctccttctgtacctttctgcccctgggtccgggccgattgagagacaaagaccgtgtcagggggcagcagcaggagcgggatgtccctgtccaccccccactggtgagccgagccctgcgcttggcccagccctagcctcagttcctcgccgggaggggcctccgtgatcacgtgacggccgaggacgccccctgggacccaggaggggccggggcggctgctacgtccttggtcaccgcctcatggcctcagacgccccgactccaggacccgacacggaccactgacaggcctgtgcccccttacgtgtgccctcacgtgacaatggcatttttcaggacaggacgagctcggatgagagcgaatgagggagaaccggactcgcactcggaaaagtggcccaagtcagcagaagacaaaccgagcagggacggacgtgacgtacctcgtcacggctcctgagaagatcctctcgatcatcttggtggatatggctgcaaagggagagccgggcgtcagccaccccacagcgggcaccaccctcctcgagccggggaggcacgggagcctcggggccgatctcccgcacgggccccgccccgggcacagggtagtgcgttccagtcttggtggcctgagcccaagtcaaggccacaggagggaaaagctacccagggctccaggacggggggacgggaaagagcagaacacgtctattcgctctccccctgatcgtgatgaaagacaagtgcttttcaactaaaacttgactaagaagtgaaagtgaaaagcacggtatgactttgctcgagcggccgtaacaaaggaccccagaggggtcaaacagtagacgtttctctcttttctggaggctggacgtctgagatccaggtgcaggcagggctggtccctcctgaggcctctctccttggcgtgtggacgtgtcttccccccgtgtcctcacgtggtcgtccgtctgtgcgtgtctgcgtcctcatctcctcttctcatcaggatcccagtcctactgcatcaggacccgccctcatgacctcatttcacctccatcccctccttaaagacccgtctccacacacagccccatcctgaggtcctggggtcaggactccaacacgtgaatttgggggacacagttcaccttgtaccaaacaagcactaatgcccccaagacggggaaatgaagacaaagtctgccccatcccccaattctttctgcctcaatggacgtcacccctgatgggaaatgaccacatgggttataggatgaattgtgtctcccaaaaacatatgtccacatcctgaccccgggaacctgcgaatggggccttatttggaagcagggtctttgcagctgtgatgaagggaaggatggagaggagggcttcctggaggaggcggccctgaatcaaggatggagaggagggcttcctggaggaggcagccctgaatcaaggctggagaggagggcttcctggaggaggcggccctgaatcaaggctggagaggagggcttcctggaggaggcggccctaaatcaaggatggagaggagggcttcctggagggggcggccctgaatcaaggatggagaggtgggcttcctggaggaggcagccctgaatccaaggacagcgtcctcctcagagacagaagaggagacgccgacgcagaggagcagccccgtgaggacggaggcagagacgggagggaggcggccaccagcccggggaccctggagccccagacactggaagaggcaggagggaccctcccctggagcctccggagtgagcgcggccctgcgacccttgacctcagactctgggctccaggatgaggaagagcgaatgtctggggtttgaggcccccagtcacgtccacaccaaagaacactcagaccctcaaacccagtgatgggaagacatgagacatcagtggaacccgtttccgcgggctccatggcacagggtcagctccgacctcctctgcctgttcctttacatgacatagggacgctgcctgctgctgctcatgcaggaaccccttttaggttttgaacgtggcacatggaaggactcaatggaccaacaggaggccactgccaacctggaaagtgctcggtcaccacgagcccaccctggaccccactcctgccgaatttacagcacggaggtcaagttaggactggaactgagagggacccgatgcccactcagatgcccacggacgagtgttggcaggatggaggccgtcccaaggccagccccagagacaccagtgagcagggcggatggcatccaggggaccctcctgcctcctttgaccacagacaaaacagatgccggagaattcagacaccctcacgaatgtggtttcttaggaaaacaattagatcgaaagggacgatgggctcccagaccctgcgcagctgcaggacccaggagtcccgcgtgtccctatttcccagtgtcccacgtgtgtcacgctgcagggagctgtgtgtcccatagaccgtgtgtgtcgttgtgcagtgaaaggccgctcttgctgggagcaggtgaggggggagacggatcaggccacgaggcccagggcggcggccgtggctgatgacaccggggacggcagggtgccagcacgtgggcccccacaggccgcgtcctcaccgtggtcgttgtgccgggccaggtcctgcgagtcgatgagaaggtcgtggtccgtgtccagctcccagaacttgcagtaaatgacgtagaagtgttcgtaggagaaatactccgtcagctggttgatgtcggcttcctcttccaggagtgccacgttctgccagaacaaagcggaaaagaccctgcaagacgctgagggcagtgtccacaggagatgggcctccctacaggggggtggggacaccctacaggagcctcccattgcgaggggggctgaggctggctcgagggctggaagcatggcacccacgtcagggcttcgcctgaaactcagcctgactgcccgcagcaacgcagagcagccggtgagcacaaacgccctcacagccagggcctctggacgtgggcaggtcagcgtccacccccatgcctagatagatggatgggtgggtgggtgggtggctggatggatattggatggatggatagatggtagacgtatggatgggtgagtggatggtaaatggatgggtggtggatggctggatggcggagagtaaatgagtagatgggtgagtaggtggtaaatgggtagatggatggagggtgatgagtgggtgggtgggtggtaactggatgggtgggtgaaagtgaagagctcctgccccagcgggccgcccacctgcaggaacgtgctcctccggagctccgcgcaggtgatcctccctgaccaggacctgttgaccgtgtagaagatcctttggatgacctgtggaggggggctgtcagctgagcgccaccacgctgggggccgcagctcctcagacatgacccacacgtgacccctcctggtcctgcttgtgagcttctgtctgacctcaggagggactcggcccccctgggctgcaggaccccatgtcaccagcagagggcgcccgccgtgcacgtgtcagacggttgggtcaggacgagatccagcgtcctggggcagggggccccagaggactggcaggggctgccggctgcccactgggagtcgtctgcatcgggcaccctcggctgggcccgcgcgtgagctggatgcctgagccgggcggggccgtggacgggagcccctggaagtccacaccaccgtggggcctggaggaaaagctggctctgacactttcacactgagctcaccactgcaggatgacagtgacttcaggctgcacagcgacggtgacctgaacagggaggcccaccgtgcgccaggctcagccctgctccactcagggacggcccctcacctgtcctcgtcctgggacctcccctcacctgtcctcacctgggacgtcccctcacctgcccctgtgcagtgaggacagtgtgtgtgaggagcacccccacgaggcctcgtttacattcagcactcgatgttctgggtatgaaacacaattgccatcatcgttcctccctaaggacccctgtggggtgacgtggagcactgacaggtggctgtggcacacgcgggcacacccgcagctccgcacacatgcactctgtgtgttagggacagacaagggctcccagccgggtgcacagagcagactgtggggggccccagctgtgccccttggtctggagctggggcggaggctgacccggggaggagagtgggcgggagacctggctccacaggcggttctgtgatgggcaggggtggggggcagggctgggcccgagcatccacggatcccaggggggccggcgctggcatgcgttgcttccaggaaggggcgcatctcctcccctgaagctaagacatcctcaggggagcggcccaaggccaactgttcctgcctggggagtgtgaacgcaacacacgcatctttggaatgtcccctccccggcacctgactcggctggagtctgagtgtggacacatgagacagcgcggtgcctcctgcctgggaatgaggccccacctcccacggagcaacaactactgacatcgtgtgcacgggcgaggaagacaggaccggaagggccacagcgcccgggaagctgggtctccacgcgctcccagcggggatgggcccgggcgccagcgggggctgggtactcacggtggtgatgtagcgggagtggaactccgaggcctccttcaggaaggctaagccggggtgcgtgttcaccacgtcctgcacacggggacaagacaccgctctgggacccactgtcgcccccagagcgcaacacatgtctgtgtcataacccacaggggctcctgcagtgagaggccgctgctcagcaacacccggccgcacagcagctcgcacaaagtcccgtcagatgcacgatgatctgaatcagcgggtccacgagccaagagagcacaggaccgtctggacaaagccttcggggtcccctcacaatccagtgtcactcgacacaggtacacaagcaccgacatgtgagtccccgtgaagtatcccagtttacgaagaactacaagcatatgaagctgtaaaccatgttgacccaaatggttctggtccttcagtcgctcagaacattcctggggacacggagctgactccgctctagtcgccccgtctgcagaagcagcactaaacggtcctaaagggaactagcgcagcacagggagccgaacgttctcaacactgtgacgtgcttcacggagacgcccggggccctgctgcctcgtctgcatgactccgcgggctcaggtcacggccaggggaaggtctgcactgtcccccacgcgcactgcactgcagccgtggtccgtgacccagctttgtgggaggagtaagcaccctgagggaagggagccagactcccaacctgtgtgcagtgtagacacagggccacacctgtgagggcgagggtgtgtggtgtggatgtgcctgtgagggagtgaggggtgcgcgggtggcgctgtgtggcccgtgtgcgggcggcggtgcgggcgtacctgcaggaagggcacgaagtcgtcctgcacgaggtaggggcagccggggctggcgagcaggtgcaggaacctggcagcggcgtcgtggcaggtctgcaggaccctgcaacacaagggcgtccagcggcctccgggcgtgcgggggtccctgcgcgctgagggaggcgccccacgctggtgtccgcccccccgcgcccccgccccggcccccaggactcactttctccacatggccacaaacttgtggacggacacggcgcctgtgcgctcaccgccggccccgcagaagagcggccccttccagtagagcgggcagccgcaggccctggggagggcacaggggtcagcgcctcgccccccaaacccgccccagacgcggcccagggacccacccgggaagaggcccccactgaacccagctgccaccgcgggggggggggggggccgcattcctgccaaacccaaaggtgcgctcatgcctccgctggcggcgacggaaactggttccggagcggggcccccaccccctccccggggtccccaccacctcctcggagcacacgcgcggtcccagctgcagcagccagcaaggcccaaaccccgggaatcaagcagcctgcttcccgtcccacgagcgagacaaaagacggtgacaatagcttgtgaatgaggtcatctcattgataaactataaatcagaaaatatcttcaaacgacagtaatgaaaatgttacacatcaaactttggaaggcagcagtgactttaaacacgtgtaccgggaaaggcggctggaaaccatcgatctaagcttctgtctcaaaaaaggaaaagaaggaagaaaaaccataaagggcagaggtgaaagaaaaacaaacaaacagccagtagagaagatcaacaaaaccaaaagtcagttctttttgaaaagattttcaacggttaattaccactttgcaaaattcctcaagaaccaaagaaagaaaacagaagttagcagtgccagcggccaccgccatccacagcactgaaaagacggggagtggacactggaataactttatgccaataaacacggcagcttagggggaatggacaacagacctgactaacgctctcgcctacacttcttgcagaaagtgaacccgtaacttaaaacttcccaccaattcagacccagaaggctttgccagtgaattcttccggacgttagggaagaaatcctgctgatcgtatacaaagtctggcaagaataaaaaagggacgtttcccaggtcttgctctgaggccagcacgtcctggatacggaaacctgtcaaggacacaagggcgactgcaggccggtcgtctctcatggacacagatgctgaagtcctgcacaaaatccacgttagcaaattgaacccaacaatgaaaggtcatcatcagacaacagacaggacactaaggacagacgggaaccccttcttctaagggaaggtgtcacggaaaccccacagctcgcatcagagcaagggcgacatgtgaaggcccccgcccaccccggagctgggacgggggagccaggggacccagccaggtcagcagggcagagacgagtcacagacacagaggccggaaaggaagaggcaaaaacggacgtgattcacaaacatgggacagcgtgcagaaaatctgcaagattagaaaatactagactccacaagtaacttttgcaaagttgctggatccaggcacaatatgcagaaagtaactgtatttcaatatcctaccaacaaactgttagaaactgaaatttttaatggcgccatctatcaaaagcattaaaaaaaaatcaacctgtaaataaatctcacgaaaaacacgtgcgacctctccagagcaacgctgctgggagaaattaagaccctcgagatggaggcacatcccgtgttcctggataggaggactgcgcgttgttgaaatgtcggttgttccccaatgacaaacagattcacgcaaaggcgatcacgatccagcagggtgagtttctgtggaaacatgagccgattttgaagctcgtggcaacgcacggactctgaagacgtcccgtacggtcgcatcagaacagactgtccgagggcgggagccacgagcacaaggggagggagcagaggtgagggacagaccccgctcggtcagctactcagcacagaggctgcgcacactcagcggggaacgcacgtcttcagtgagggcggcaggcgcggcaggcggaggggacaccctgcttcaccccgcgcaccacaaaggcgtgatggctcccggccccaaatgcgaatgggaaaccagtaaacctgctggaagaaaacgcaagggaagatctccctgattcgggagcagcagaaatgcctcaagcaggacacaaaaccccgtcaaccccgaaggagaagacgggcagcggcaccctccaccgctcatcactgttcctcggaagacgccgcccagacgaggacaacacagacgtggctggggaccgatgtctgcgacgcccgcgtctgacaggactcacatgcaggagcgtaaggaagtgccgatcgacacgccaaaggcaaacaccgcacagcaacagccgtcgagggcgctccagaggaaaggaccccaggggacggggagtggggaacgcgcccactgccgacgctccgagggagatggtgatgctcggagggagacgccaatgcaaagcctaaagaggggccgacagaaaggcctgtgagacgggctcctgctgggaggactgcatgtcctgggcgctggcagggaggccgtggccaggtgaggggactggggcgcctgcaaggatggtctgacaggacctattgagaacgggccctgcgcacgcccacagcccgagctgtcctctgaggaggaaacaacagtgacgcccaccagactcgacgagaatgttcgcagggcctttattcacaatgacccagatggaaacaccagctgtctgggtgccgggctggagggacaaactggaacactcatggctgtggggtgctggcatgaagggggcacaaggggctgctgggaggatgctcaggccagacagtggactgaggtgcagcgatgggaagaacagtctggctgcgcgcagctgtgcatgcacctcacggaggcacagtggccggagagcggacgtgggaatgtccaggagacgctcagagcacgggctggtgatggaggggccgacctggctgccaggaatgcccagcgtctcacgccggggggtggcacgtgggtgggtgaaaacccgctagattaggacttgggggggacggctctggcgtccacccccagcggcttgtgcacattggtgcccctcccggtaggggcgcccctccagtaacggctcctggaaggtgtggtgtgcctggagggccaagcccacccgtcccacaggccgctggaaggtcagtcctaaagcttcgatggtgacctgaattacctcccgggactctctgtgcatattctgaagtgaatgggaaacacgcactccaaaacgtaaaagacacaagggaactttgtttaaatactgtaagactgtcgctacgaagcaaaaacacgtcacataacacgcttgtacttggtaaggggttttctctaacaggcacacagggagacgcactctgcaccgtgcagacgggccccagagcccgcgtccgccccacagtcaggggagggccgtgccgtcactgcccctccagtggacacctgctacacacgcccggccccctcagcccccgtgctctcttcagtccccatggcgttgctcttccagacgctcacgtaaatggaatcaggccacctgcggcctttggggcctggcttcctccagcagcaaaatgcacctgaggttcatcaacgttcttctgtgtgtgaataagaactgtatgcgtgtggcccctgcccctggttcctgacactgagcttgtgaagctttgaatcctctcacagacaggggtgccaggagcatccgttcttctaatatttggttcctgccgctggttcctgacacccagctcctaaacccctcggcatttcctgggtgatgggagggtcttgtcctaatgaggtgactcttcctggctcccagacggggctggtcacccgaaaggccatgtcatgactagaaggtgggagctctgtgcccacaccctcctcaggggaaggagtggctggtcactggggaaatgacatcctgcctgcagagtgaagccgccattaaaacaacggggtctgggagctcgcgggttagcaagcgtggccacatgtcggcagggcggcacaccccatttctgagggaagagaggcggctgcacgggaactcgccctgcgtgctttggcacctgtctgctcaagtctaccctaaaaggtgtgctttattatatgatgcaccggacatgaaagtaactgtgtccctgagttctgtgagctgttacagcaaatgaccgcagccgagagggggcgagggaacccctgaatctacagcaggtggggccagggcagagctggaaacctggacgtgggtctggcatatgaacggggcagtgcatgggcgtggccatcaccgagggatgtgacagcggctgcaggcagagggtcagaactgagctgcaggacaacagctggcagctagagaggagccagactcaggtcacaggagcactcagtgcagggaaggagagtgtccctgttcagtgtgcatcagaaggttatttactcagtggtttacagcactgttcccgtgtgggtcgaccgatacccaaaagtagggaactgaagacggaggtgaccagagaacacaagggcagagctgtgatgacaaaggggaatgcacgaggaggacagagaccctcagcaccacactgtccacagagggtcacagggcacgaggaggacagaggtccctcagccccacactctcccagagggtcacagggcacgaggaggacagagaccctcagcaccacactctcccagagggtcacagggcacgaggaggacagaggtccctgagccccacacactgtccacagagggtcacagggcacgaggaggacaggggtccctgagccccacacactgtccacagagggtcacagggcacgaggaggacagaggtccctgagccccacacactgtctacagagggtcacagggcacgaggaggacagaggtccctgagccccacacactgtctacagagggtcacagggcacgaggaggacagaagtccctgagccccacacactgtctacagagggtcacagggcacgaggaggacagaggtccctgagccccacactctcccagagggtcacagggcacgaggaggacagaggtccctgagccccacacactgtctacagagggtcacagggcacgaggaggacagaagtccctgagccccacacactgtctacagagggtcacagggcacgaggaggacagaggtccctgagccccacactctcccagagggtcacagggcacgaggaggacagaggtccctgagccccacactctccagagggtcacagggcacgaggaggacagagaccctcagcaccacactctcccagagggtcacagggcacgaggaggacagagttctcagtgttcaggaagcagaaccaacaggttgcaaggaggaaatgtagtcaccagtggtgatctcagaactagtctcgaacactgatggaaccagcagaaaatctgcagaaacacaacgtggtgataacactacctaacccacacagcaagctgacattcaagacccaatgaatcttcaagtgcacatggacacctaccaacctctcgccctcaggcaagtctgagcatattcaaaaggacagaaatgagtgtatctccctgcccagtccagaatcaaagtagaaatcaataacaaaatgatgtctgaggaaaccgcaaacttgaaaatcaaaacaacggaattctaaactcctcatggagcaaagagaaactactaggcaaatctgaatctagccagcaaggaatgaaatgaaaataaaccaagccacgaatgcgtgggtcgggtacgcggcttagaaggaagtttacagcaattttaacaacgcttccgttagcaacgaagaaaggctgaagggccaacgctgcctcgttaagaagctggaaagagaagaaattagccataaaagaagcagaagagaggaaacaccaaagaaaagatctgaaatcaaggtgatagaaaataattccataaaatcactaaaactagaaggtagttcttgggaaagagcagacgattaaaacacttctggtcgaagtgactggaataagaagagaagacacacgtgcccaagacagagctacccctacaggccctgaaatgtggaatcttacgaacggcgcgtgccagcaaattcagcacaggcgacctggacagagactcagaaagacacacgcagtcaaatgccatgcaagaaaatgccagcaacctccacctgttaaaaaaaaaaagaggaaattatagttcagaaccttcccagagagaaaaaactccaatcccaaacggcttcactgtgaattctcgcagacatttaagtaaaaaaaatagcgccaattgtaaaccaatgattctggaaacgagattaataaggatccattctgtgaggccagatcatcctgacaccgaaatcccaggaaagacaaccagaggccacctggttcggaacctaggtatgaagccctaaggaggcacgagcagtcagaacccaaaggcacaggaaaggcggacaagggactcatccagaggcaggtgggtcaacattcgctcgtcagtcactgcgcacacgcggaaaagcgctggagcagcgggaacacaccgtcgcgatgttcaaagggcgcccagcatggtagacgcagtcggagctgccgggacgggtggagacgcctacgccagccccaccccaccccgtggaggcagcccgacgctcccggggctgggagaggcgaggcctgtgccatcgacaccgcagcacaggtcccgcccgtgcgacaaggcaggaaagggaaataccagacagactgcaacggaaccactgacctgcctttattagaagaggacgtgagcgtctgcgagactctcttcatcgacccgagaaaatctacgtcgtgagtgaggttaggtcacaagatacgaaggcaacatgtaaacatcagtagtagttctatatacttgcgaggaacactcataaactgaagtaagacaatgctatttacggtgtcatcagaaataggaaacgcttggtgatgcccgagtgctcacacattgataagagacgaacacgacgtgtacaatgaaaaccacgggatggaacggagagaaacggaagactcggatagaggcagggaaatgccgtgtcctaagtgggaagagtcgatgttgtcgcgatggtggttcccccaaattcatccacactcagagccgtcccagcccaaagccagcggctctttctgcggacgcggggatgactctaaaactcacgtgggaatgcagagaagctggaagagtcacggcgctcccagaaaaggaggaggaggacggaagaccaggacctcccgaatgtgcgccaatgatgaagctgctgtgtgaagacggcccctgctggggtgccggacacacgcatcgctgacacagcggagtccggaaacggactcacacgcgtaccgtcaactgacgtggggcaaggggcaggcaggccaccgggaggacacgctcttcaacaagtggttctggaaccacagagcagcgtctgcaaaagaggcagcttgacaatcacctcacaccacgtgcgaaagaccaactcaaaattattgaaggaaaaggtaaatgtagcagctcctagaagaacacacgggagaaaatctcagtggccttgcgtttgccaagatttccttacaggcaacaaatgcgtgaacgacacaggaaaaaatctggaaactcgatgttatcaaaattaaaaactgttgcaattctaaagacacggttaagagaatgacaacacaagccacacactggggggacacacgtgcgacccataggtcagacaaacggcttgaatgtggaatacagaaaaaggacacacaactcaacagtaagaaaacaccgcattttaaaaatgggcaaatgatctgaacaggcatgtcctcaaagaagatacacgctgacaaatgagcacgtggaaagatgcgctatactgtcactcgttagaaaaacgcaaattaaaacaacaaggagctctctacgtacccgtcagaagctgctacggcctgaatgtctgtgtccccccagagtcttatgtggaagccctaagccccagtgggatagtacgaggacgtggggcttcgggaggtggttgggtcatgagggtggagcactcatgaacgggatcagtgtccttacaacagagactccagagagctccctcgccccgtccaccacgtgaggacacagcgaggagacgccacctgtgaaccaggaaacaggtcctcaccagacaccagatccgctggcaccttgatcttggacgtccagcctccagaacggagaggaatgagtgtctgttgtttgtaagcccctgactgtgctgcatagtgacagcggcctgaaccaagacgaaggctaaacttgaagagggtcaccaggtgtgctgaggacgtggagcccccggaatcctcgcacacggctggagggaatgcaacatgatgcagctgctgtgggaatcagctgggtggttcctcgataagtgcgagagagaatcaccatataacccggcaattctactcctcggtgtgtgtgcatacacacacacacacacacacacacacacacacagaaaacaactgaaaacagggattcaaacgcttatttacaatcaccaagaggtggaaacaacacaaacatccatctatggaggagcggataaacagaatgtggtccatctgtacagtggaatattacttgcctatgaaaaggagtgaagccctgacacggctacaacgtggatggaccttgagcacatgatgctcagagagagaagccagacacagaaggacacagactgtgtgatcccatggataggaaatgtccacaacagcccaatccacagacagaaaggggacgcatggttgccaggggctgggggtggggaatggggagtgactgctacagagcccgggattcccttgtagggggatgtcaatgttctggaaccagacagtggtaatggttgtgcaacacggtctatgaaataaaggcccctgaattgtacatcttaaaacggctagaatgctggtggaactttatgtgaattttaccaccatagaaagaatgaaagtatctgcagaatgatttagtttatgtacaattctagaaatctctaatcaatagtgcccacagggagcctggggctgggagcgggaggatgagaatcgagcagagtttaggggccagtggagacgctcatcatgctgactgtgctgacgggttgacagggcccactggagctcaccaagctgtacacagcacacacccactgtttctcgcacagcaactgtgcccggaaaaagccgccaaagaagtagaaaagctacactggtttcagctcgtggggtcacttttatgctcccacactaacatgcaaagcgaggaccacctcgccaatggggagtgatcgccacccataatgttcagagagaacacacccaagcgtagaacagggtgctacttctcatccaagaaatggaagaaattaaatatgtgtgtacatacacagacgtatatttgtatgtagttgctcatattaaaaaaataaaaccataaaggataagccaaagttatgaaaactgttacttatgggggaggaagagaccagagttgaacagacaggggtagactctggacttatgagaatatatctggtttgtgagttttgaccttggaaccatgtatgtttttacatacttataaaacaaaatttaaaaaggcgatctccaacagaagagaaggggacacttccgatcttcctcttggaccagtgttaccctaataccaaaaccagacacaggaatcacaggaaaactgccagccagtatctcttctggatgcggacacaaaaaccatccacagaacaccagccagtgaaatccagccacgcagaaaaaggaccacatacgatggccaagtggaatttgctccagaacgcaaggttggtttaacattggaaaaaccagctcacgtaacgcgcctcatccatagaataaagaaccaaaccacacgggcctctcaacagacacaggaaaagcatccgaccaagccaacatcttttcttgataaaaacgctcaacaaaccaggaatggaaaggaatgtccccaacccgatgaagggtatctgtgaaaacccacgctcacagcatgcttagcggtgaaggactggatgcttttcccaaggccaggatcaagaatctccactctcggacatcaacaccacacgacgctgcaggttcttcccagagcagtcgggcgggacgaggaaataacagatccacaccgggaaggaagaagcgaaactatttctagccgcaggtgacatgatcacgtacacacaaaatcctaacaaatacactaaaaaactattagaacgaataaatgagttcagaggactgcaggatacaagatcagtacacaggaattaactgcatttttatacacttgcaatgaacaagccgaaaataaaatttagagacgcattccagttataatagcaccaaaaagaataaaatgcttcagaacaaatttaacagaagacgtgcaaaacttatacttgaaaactacaacacattttcgaaagaaactaagacctaaataagtgggagacgtcctgtgtacacggatgagaagacagtagtacgacggccatgctccccacaccgatctacagggtcaacgcgggcccagcagaaccccagctggcgtctctgcagaaactgacaagctgaccctaaaatccataaggagttgcaagggtccacggagagccaaaacaagcttgagaaggaacaaagctggggcactcacacgtccccatttcaaaactgactacaaagcagcagtaatcaagacagggtgggactggcataaagacacaaggacgggtcaagggctagaatcagaatccagtaccaaaccctcacattcacggggaactgattttcaacaagggggccagggccgccggatggggaaagaacggtctcttcacccttggtgctgagacaactggatttccagacggaaaaaatggagtttgaccgctgcatcactatattcaaaagctaactcaaaatggatcaaagacctagacgtaaaggccgaaactagaaactctcaggaaaaaacaaaagcaaatcttcatgaccttgcatctggcaatgatttcttggatgtgacaacaaaagtacgggcaacaaatgaaaaaatagataaaatgaactttatcaaacaaacaaaaactttctggcatcatggaagactaccaaaaactgaaaaaaggggtcagcctgggggtgcagtagttcagtttgcactctgcttcggtggcccagtgttggtgggttcagatcccgggcacagacccacacaccgctcaacaagccatgctgttgcagcagcccacatacaaaatagaggaagactggcacagatgttagctcaggtccagtcttcctcagcaaaagaaaagttaaaaagagctcaggtcaattctcagtttttcaggtgctgagtacgtataattgaaaaaaagaaaaaacaactcagagaatgggagaaaatgtctgcacaccaagtattggataagggacttgaatctagaatatataaagaactcttacaattggacaataaagtgacgatccaattaaagaacgcgcacaggatctaaacaaacatttctagaaagaagatgcacaaataggacacgctgtctacaatcagcaagacaacaagtgctggcgagggtgtgcgagatgggaaccctcccacgctgccagtaggaacgcaaaacagggcagctgctttgggaaacggtcttgtggctcctcaaagcgttaaacatggtgtcgccatgtgtcccagcgattccactcctaggcgcgtgtatccgagagaaccctacacctgcacaccgagactcgcagacgcgtgttccagcagccctgtgcaccacagcccaaaggtgggccgacccagacgtccatcagttgatgaacagataaatgcacaacgggacactgaaaggacgtggcaccgacatgccccaatgcggacgaaccttgaaaacacaggctcacgcgtatttttgctttattttgcaataaagcacttcctttcttgctcctcgctttaccgcgctttattgcgtttttcaccagacgctccagcagcaaagagaagaggacgtgctgaaggctcaggtgctggttagcgttttttagcaatatggtatttttaattagggtatgcacttttctttagccacaatgctatcacccacttagactacagcatagcataaacctaacttttatctgcacttggaaaccaaacaattcgtgtgactcgctttatggcgacattcactttgttgtgggggcctggagccgagcccgccgtgtcgccggggtctggctgtgtgctgagggaaggaaggcagacgcaaaaagccacacacggtacgcatctgtttacataagatgtccaggatactcgaacctacagagacaggaagtggattagcagggggtggggcagggggatgacagctaaagggtacagggtttcttttaggggtgacaaaaacgtcctccagttgactacggtgacggctgcacaactccgggcatacgctgcgttgtgctgagttgtacatttgaaatgggtgaactgtggcccgagagttctgtcaataaagctgttccaacaagaaaagaggacaagccctaaaaacggcaatcaaaagggagcacgtgagccattcagcaggcgggacagaacctgctcacaacacacgtggacggagggtcagcatccagaacaggaagagacattccagaggggagggcggggacgaagaaagagagagaaagcaccccggaggcacaagggcaaaggggactgtgggcccaccggcacccaccctagacaaggagagacacggggcgggagggcgcagaggaaggcccaggccggacctcgggggatcagttgcttaaaaaacgcaaaggtgaacgctgctccatctgggagggcaacgacacacaggcgcgtctgtcttcttcaatattcggcacaaacgttaatacagagtctgcactgtgtttcagatcctgaaaacagaacacaagcaccaacccgtgaacgtggtgctgcccagaggccgcccgcggggcacccaccttggccaccttgcccatgtcctccatggtggctctctcgtgcgggaactgggcaaaggtccgctcaatcttggcgatgacggcatcgacgttcaccgtcccctgcggacggcctcgggggaagtagaaggtggggatgctctggctgctggctggcggcaggggctcctccttcttcgtctggacctgagaaatgagacaggtggtgaggacttgggaacgggaaacaccgtcctcacatgaacccgtaacagacaggggcggcaccgttctcaaagtgagcgcacggggccgcggaaccccaatgtgcacagaacgccagacgatcctgggggccaactccagccacgaggccacccacacccgaaaggtcacacaccacaagggagcgtcacgtaccactgacccacactgctgagcctcccccagccctgcctcagtgtgaccccgcaacagcgacagctgacggcccaggctgcccgggaggccggcgcaggtccttgcggggaaactgccccgcggtcctcctggggtcagggtcctccaggcgggccgtcaacggtgctcgctcacagccaggacaggtgtggcctctctttggagcccacacctgcagtcgctggttcccacgtgtgcctcccggagaatgggacatacgtctgtcacctgacctgggatggccctccgggaaaggatctggccctgcggcctcttgctcgccagaatgcggaacggcagctgagccaccccaagtgaagccagcaccttcagcaacaacgacctcggagaagtttgacctcctgacacactttccaagacacagtggtgtcgggacgtgccctcggggattcagggagctgacctgctgtggggctgtcgttacaggcggaaggggggactctgtatataaaacacagttgtttaaaatgcccccaagcagaaagaggctgttcagtggacccggttaaggaatgactgccgaaagtcggccccgggccgggtctgcagcaccgtggggggagaggctctgagcctcctctgaggctgaggccatgaggctcgctgttcccgccacagcgggcacggtcgcccagcaggactcagcagcgtctccacgctgactcaggagaggccttctggggccagaaacagctcctgggagccgggtcgtagacggccgccgaggaccaggcacccggttgtcctcgacgggcagtgacagggaggcacagtccggcccgtggacgcagctccggtccacaccctgcattctctatggctggggacacgaggccacagtctcaagagtcaggaacagcccagcgtcctacctgggaaggagtggactaaggagcacaaacccaatgcctgaggccacgggggctgatggggccgggagtgggcggacggtcaggagagtgcactgtgagggtccccaagtcaacaaggtctggggaacccgatgcacacgggacaccacgggaccacataggacctgcagaccctgagcgtgcaggagacacacacacaacacagcaggccgaggaaacgccacagagggttcagggcgggcccagtgaccgggcacagtgtggttcttacccagagcaacagcagtgccagcaggcccagacgcccagttggaggggtcccgtccatgcgccacggggcactcacatgtcagccaccctccccaaggccgagtgacagagcacagctcacgcagccaccgcctcatgccacagggaccaggggctggaacaccaggtaccaacagcactaccaatttgccaccaggacacacagtcaacacggctccacactgaaacttgtgggtgtcctacacatcttgtcctgcaacgagggcctcttcccaacccagctgcagcctctgggaccggctagcgtcctcctcagtccatcagtccatctcagggacggccccgtgttctctcagtcacgtctcaggatggccccatgtccccttcagtcacgtctcgggacggccccatgtccccttcagtcacgtcttgggatggcccctcgtccccctcagtcacatctcaggatggccccatgtccccttcagtcacgtctcaggacggccccgcatccccttcagtcacgtctcaggatggccccacatccccttcagtcacgtctcaggacggccccgcgtcccctcagtcacatctcgggacggccctgcatcccctcactcatgtcccgggtcggtccctcgtccccctcactcacgtctcgggaggggcccacgtccccctcagtcatgtgtcgggacggccctgcatcccctcagtcacgtctcgggacggccccatgtccccttcagtcacgtcttgggatggccccttgtccccctcagtcacgtctcgggacggccccatgtccccttcagtcacgtcttgggacggcctctcgtccccctcagtcacgtctcgggacggccctgcatcccctcagtcacgtctcgggacggccccatgtccccttcagtcacgtcttgggacggcctctcgtccccctcagtcacgtctcgggacggccctgcatcccctcactcacatcctgggacggtccctcatccccctcattcacgtctcggagtggcccacatcccactcagtcacctctcgggatggccccgcgtcccctcagtcacgtctcgggacggccttgcatcctctcagtcacgtcccgggacgccctgtgtccctgtctgttttccctccagcgctaggaggaggagtcacttgtaaatgcttcctgtcctgccccactgacgtgacccacagacggcagcaacacgtccagaggtgttgctgtcgtgagtctgctgtactggggggctatggggagagcctgcagacgcacgacaatgagcccagtgatcacaacagggcaaataaaacagtcaggggttggacgcagggtcacctcagtgctgagagccgagaggcaggtgtggacggcgtggcgatcagaaaggagaggctgcaaagggcggccctgaggttccggcacctattgcaggccggctgtgctgagcgaggcgggtctgccatggacggtgggaagcacgaggaccacactgcggactgagcctcagagcagaggctggacgatgacctcgggcccacccttcacgagactcgggccgagtcagcacccagggacacaggctgatccccctcctcccagcccgggatgtcctgttccacggggattgggttacagcgtcagaatcgctgagtcctgatgtgacagccctgcacagcagcactgggccaaaaccacacccaccgtggcccagggacaggcgggaggggaagccacacccagagctgcctccttggaaggagagggttcggttcaacagacctgctgggggtgcccaggattcgctttcaggaagataacttttcccctcgatttctgaacaaagactgagggtcgtttttcggtttttaaattttttgtgaggaagattgttactgagctaacatctgtgccaatcttcttctacttcatatgagggaggccgcctcagcgtgacttcacgagcggtgccaggtctgcgcctgggatccgaacccacaaaccccaggccaccgaagtggagcctggaaacttaactgctgtgcccctaaatgcctacgtttacttcccctgtggcggtggttccgttttcccatctttctcttttcctctctccggcgaggccgaatgaattgcgagcccaatgccctgagctgtcggccacagtcgctgcgcttgtacctttgtgcgagaccgtgttggtgtttcctgagcaccgaccacatcttcccatgcgccatctcactcaactgccgcgttcaggacaatctgtgactgacgtgccaccagcatcccgtattcacggtggggaaactgaggcaccaggagtctggcgctccaggcagagggcagggcacctacactgtggggtggctgcccctgggcaggttctggagccgttgtcagccatgtgccttctccccagtccacggctgggctgacacagacccctgggttgctcagtcacagggacgtcgttccctgctggtcagcgctaggcggccacgctcctggtcacctgggaaaggacgaggaagagggatgacagcactgctacgcctccatgcagacccactgctcggcctctcgcctacgaccaggtgtgattcctgaaaacgaggttgctgtcaccgtggcttctgccagacccattacacggttaatattcaggccggtcctgagaaaaggactttgacaaaatggacagaacgtgacaaagaacctaaatcaaatcttcctgcgtctgtcagtgcacagcaatccaccacgaggctcaccctggcccccctggctggccgagcgtccccgtgggcgccctcctccacctggatggccacaggcaaactccagctggcgacggtgtgatgctgactccaccacacgaagccctgagagcagcggggcgggctcactggggcgtcctggacatgtggtgtcaggccctgtgtcgctcacgcccactatccgtcccccctcctgtggagacacagggacatttcctgcccaagggctgccaagcgacagctctggaacctcgccggacactcacgaggaagtctgtcttcatctgcacaagtcacgcgcggcgaccagacctcctcatgaatccgcagtctacgcagacgtgaatccgggctgggatccgtgaggaaggctgtgccctggggtcctggcagctctgcctggggaagtaacgtggcctttgtgccctggtgacctcgcagtgacctggccgccagcacgcgtgaggggagggtgggaggccagcaggcccctttgtggagcaaccgcagcagcgagtgctcgtggctcctgtcccgggcgcgaggatacacgcaagcacctcctgagggagcttcgggggcctggtgtccctggtgctggtgtctgcacacaccacagtcctgaaggtgggcggtccccaccacgggctgggcacctgtcccgcgttgtttaaaggtgagcgagcacaagaagcttacaaaggccctgatctgaacgggagcacagggacgcggcccgcatggcatggcctcagcaccgccagagtgtggctcgtccacgtgctcctgcgggaggagctccgggggccaccagcatctccgacactgccttccctcctgccccgtcagcagagggcgccgtcaaactgaggttccgccatctgggggaaccaaaacaccacatgggcatcatgctccacccccaccgtactctgaaccgggtggagcatctcctcatttgtctaaaaggcaaggacaccgtctttcctgccccttctctgctccacgctgtgccgtcatttctgttcctcctctgaccgttcccagggcggcacgtgtcttaggctttgtgagttttgccctgcgtccccaggccccacgtctttttatttactttgcgccgtctgtcaccacgcgggagttttcagatcacgtttgtagtcggcttcactctctcgctggtctaacagatggtccaaggcaacgctgggagctactttatgacatctgagcacgtgccctgtgctcgcgaattcagaacaacaggcaccacggggacaacgtctgaggtctgtacagtggccgatcgaccctcccacggccctgctgggcggggaggcctcggagaacaagagaggccagaggtacagacaaggacatggggggccaggtccaaggaggatggacaccgggcccccgtgacgcaggcccggccgcagtccaggagggggaagctgatgggccacccgggcagaggggccagcctgggccaagggcacggggagccccaggtcctgtgtgggcctcgcaaggggccaaagccgtgcgtcagcagcgagttcaccaaacctctgcgggtggagacacaccgacgcgtcttccgaagctgcaaagactgagcgggtcgctctaggaggcagtattcacaccgcacggggtgaaccacatctgatggtttctacccgcttcctgagcacgtggggcagagatttccacgacggcgatggcagcggctcagtcacctattcctccttcttcacgccccaccgtctgctggtccgcttgtctccaggggcaggaacaggaaggggatggggcccgacagccaaacaggtctcccagacggggctggtggggaagggcctgctggtcgcgatgcagacacacacacacgcgcacgcacatgcgtgaggcccccatgcccagggttgccacgcgagggcctgtctctgcctcagctcgtgtgtctgttcctgggggtggacgcgcggcttgccgatctccaggaaaccctcacctcatgcagcagcccgggtccttctgaccctggaacacagcagagctcctgtcttcctctgctccgggccctgaggcctcacctcgagggcacacgcgtggctccatgagacatgaccttctggatggcagcacgggacgggcagagggacacgagcgagcttactgcctcaggagcttgaccatggtggagggagggcgcccacatgggctgcgcagtgagagacggcctcctgtggtcagagccatgcggacggggggaatttggcagacggagggagggaggaagggaggcagctacaaacttaggggcaaagacacaaccacaggtctttggtgctcttgacagcgctctgcagacaccccgcatggccacactggctgccgccagcaggagggcttcccttgagggcaccacacgtcccttccaccaacacgctggtacaggaggacggtcccctgggtcaggagtttgagaaccactgcaccacagctccctgggggacagcgggtgtgtggaggcgtcaacgactgcccctgtcactgcccacctcagggcctttgtgcctactgttcccaggcaccccacaaacactgccttacctcatctaagaccatgatcagatcccacctgccactagcatgtcatcaacagacaacacaacaccccccacctgagcccactcccacctgccgtcccctcacaccaaccgtcaccccaggtcacaaggtcatccctgacatgccacacatcccaccccacctgccgccccctcatagtaaccgttaccccaggtcacaaggtcatccccgacagaccagaccacacatcccaccccacctgccgccccctcatagtaaccatcacaccaggtcacaaggtcatcctacacaccacacatcccaccccacctgccgccccctcacaggaacctcaccccaggtcacgaggtcatccctgacagaacacacatcccaccccacctgccgccccctcacaggaacctcaccccaggtcacgaggtcatccctgacagaacacacatcccaccacacctgctgccccttcacaggtactgtcaccccagtcaggctctgcaggcttttctgtcaccccaactagaaggtgcagctaccctccagtgcctggcacagagcaggcccccaacaatatgcagtgatggaacgcacatcccaaagagctcccctgaaaggaaaacaccttccgctttgtttggaaagctgctacctcagagaacttggccacgtgactctgtttccctctgtccacagtgagtctctcccagcccggaaccttccatgtctctcacactcacggggaaccaagcgtctcccgccaactcactccctgaggcacagcgcaacactggatgacccagctctggtgctgggcttgcagcatcgactcagggagaggtaaatgctaacacgtgtgctctttctgtggccctgtcaacacccaggggcccagaccagcccttctgaggaaggcagctggaaatgctggggagagcacttgacaaacatcttcctgagtgcctcacggactggcaagggaggaaggactctcagggcacggacgctgggaaggggcacccagcgaggccaggagaggctggacaggcgctgccctcagggagtgcactcaagggggtgaagtgaccgtcgcctcacagtgttgcagagctcggggacaggaggccacatccagcatcctcgacggaggctgccccctgagcgggatcccgggggcggcccctgcagcgagaagaatgaactggcaacaaatccccaccaacctccgaccccaggaaggaaaggacaatcacaggcctggaagctggtgctgcgtcaaggggctgggggcggggggtggtggcgaagctcccgagagctcacagcagactcccagtcaagtgtgcaaaccaaatgtacatcctgtgcctggtccccaaaccctccagccgacgacgtcaggctgccgcagatcagcagtgcccggaagcagcaagatgcgctgaggggaaccatcctcaactcgggactcagaaaacgccccaagttccaaggaaagtgaggcgttcatgatcaaaacgcacaaacacacatggaaggaaggcaccatgggggagagccggcaagcagggagcagccgggctggcgaaggctccggactctggcgtcgttgagaatgagagccgacacgcttcacatatcaagacagggagaggcttgaagatgcaagagtgaggagacttaagacagccccaaataaaacgtccagaagaacaggaaacacacttgctttctgggttggagagcagagcagcacagctgggagggactcgtgctccgggagggaggagacgcaggtgctgagcctgcagctgcagagctggagacacatcctgagacccgaggcccaaggaaccccaagcaggagtccttggagccacccacactgcacaccggacgacgagactggacaacacccaagacagcggcagagcctcagaacctgccacaaggagacggaacggaacagaaaaggggaccgtctccaaaggagcgacccaggagccctgcagccagcttctcgacagaaatgcagggccagagctggaggagagcggctgccctttcgcccaaacgccacctccagggaggtgtctgccacacgagaccaacacggagacagtttgagaccaaaacggaagagaagacgctggtccaggatgtgcgggggaccgtgcgtcaggcagaagccaagtgctcctgacgcaggtcggagatgcaggaaaggggcgtatggggggcaaatctcaacatgctgactgtgtgaatcatcataagaaggtgattttatttctttttaaaaaccctctgaaggcaacaacagcagtgtaaaatgaatggggtcgtggaatggaagtgtctgagagttttggttttttttcttgaggaagattagccctgagcatctgccgatcctcctctttttgctgaggaagactggccctgagctaacatccgtgcccatcttcctctactttatatgtgggatgcctaccgcagcatggcgggccaagtggtgccatgtctgcacccgggatctgaactggtgaaccccaggctgccgaagcagaatgtgcgcacttaactgctgcgccaccgggccggcccccatctgagtgttttgagctggagggcaaaggtattaatttttcacctggaaaaatccagtagtggccatttctaggatgagcagtcagctaggcgcaagggaatactccaaagtgggagaggaaaagacaaagaggaggcaagacaggacgggacgaaaatacaccaagatggacgaacagtcataacacgtggaaacagacaaacggcacagttcaaagatgaagatcagaaggaaaaagagaatcgtgtctatttagaagagacccacataagacgtaagggcgcagagggtgaacatttcaaaagacggaaaagggtcgaggggccgtggggtggctggactgacgtgcgcacaggaggcggaggtgtggacagtactagagagagacagggaccgtgtcaggccaggcgaccaggggaaacgacgcgcctcagagctggccgacaccggccccaggagccccacacggacacggcagacgctgcagggaaaagcagaggtccagcccccagggaggccgggcccagctccccggagcgatgacggagctgaccggacaacgagaaacaaacagcctgctgcggacacgggagatttacaagtttaatctccgggacagaaatagatgcggccccagcacagctgcagctctcacattcttttccaacacagagggtgcccgttgggggctggccgcctcctcggctgcaaaacaggtctcagcaggtcctgcagggaccgtggggcgtgtgccccgacctccaggggacgcggccagatgactgggatgaacaaaagtggcaaaaacacacacatgtgtgtgtgaaaggagagtcctaaagtacggctcaggcctcttaaaaaatgacaaccagccgaccagggggcactcgggtccccaagcctctcgcctgggctcccacccgccccatgcgggccccctgcagccccgatcaaggggcaccgcctcacggacagctatttctgtagagggccccggcagcctgctccctgactcgaccccactcctgggacctcagactcacccgcgggcctcccagaacacacagtggggctgagcggtgcccccacgaccaaaatccaagccctgggataaagcaaaggcatctcttttcctgcagaaaggtatgggggagcccagcagaaatccgtccagctgtgtctctggggtcacacctcccaacaccagcctcggatggtcaggtcccagaggggtcagagggcacgtgctgggacatcggatgggtccctccgactccaacgggccaggacagggcacaggtggcagaatgagagcaggccaggcagggacgctgggccggggcagccaagcccagcagcgtcctgggcggccctgtctgagaccggatgcagcagcgaggccggcacggggccctggacggggccagggagctcaggggggcggcctgtggattccaggtgagcccaggccccaaagatgctgccgcccaacaggaggcccgcgtgggccgtgagctttctcctcggctcccgtggaccgtccacgccagctggcaggaggtgcgctaactaaacgcgcgaacaacactgcacgccgacagatgggagccaggggtcaaagtttaacacaggggagccaaagacagcaacaggggagccaggccctgcacacgggtttgtgcaaaggctctccctccagcacaggaggggccgggctcactgtggaggctgctgggctggccgcgctcacaggagggagcagagctgggtccccaacactgacgcagacaggggagcccggctgagtggggtccccggcctggacactgactgtcagctcggctctgcacctgccccacaggacgggctcccatgggggcgtgcgtgtggctctggagtggcctgtgaggggagcctgcatccacagctgagtggacagaggggccgcttccggctgccggggtcctgggaatgtggatcaaagcgggtattcatgacccctcctgcagggtactgtgaccccacccacactgtgacccgctcggcctgggacctgcttggcctgtgaccccagagtgtgacccacttgccatctgggacgggcagagctggaaggccaggctgtcaccccagggaggggaggtcagctcagagtccaggactgtccccagggggtggccacactggggtctggaatgacgctcagcggggtctgtgtgcccacctgaaggaccctgcagggaggctggacggcgtgtccgggcccacagcaaggtgacagagtggaggagcgtggggggcagaggcgcccgtcaactgcgcctgagcctgtgtgtggagagcgggcgatgggacccccggggtacgggacgctcaggaccccttccagcggggcgagccgagcacatcctgggcctgagggagcctgtggtgaccaccgggagtcagcgctgctcggcgcccagaaggcccgagaatccctgggcagggcaggtgggtggacatgggaggcgggagcagggatggctccactgtggacggcacagccgcaccccagggtcctctgctccgggccagggggccactgagcgggtggcgtggccgtcaggctgaagcaccacccccctccctccacccccagcctctcccaaagacgtttgctgaccccccaaggctgtgtcccgaatcgtcccgccaacatcctggggtgaaaggagccaggagaactctccttctgctccccccacaacccccatgagaaagacccggtggtccaccgcctgcggcccagggagcactcacgttacgcaatgcacatcgtcacggctgagaaacaaggttgagacatgttttctgtgaagggaaacaacttcccgtgaaatgaattcataaagtttgattcccaaagagtgattttcatttgataagcagcagccctaaagcaatgcagactttcctgcatgggctctgcggggagctgggcccccaggcacgaccatcctgggcgaggctggagggatttccgggtctcccacacagcccagtggaccgtcaggagaaaccctaactgccccacatctgtcttcctatcgtcaaagcaggacccgtgtggggcagat

SEQ ID NO: 19 - DNA, 2846 bp, Equus caballus
ggcgctgtgggggcccggcccaggcggcgcgcattgcacaggctgaggagggcacatggctgcaggaggggtgacgggccacccctccagcgggcgggcgggcgggcggcggctgtgcaggcgggagcggacagccggacaggcggcgcgccctgaccgagcagctctctctgcgcggctgctgagggcgcgggaggccgtgcagggggcggcgtctgcagggaccccagctgcggctcagtgcggacgcacagggcacaaacaggtcagcaaggacagccgatctggggccgatcttgggccgcctgccagcgctcgcacagcggggaggtggcgctctccccagaagcaaagcctgcccgcccgcccgcgactaaaggggcccagatacagccaagcagctgttccctccctgaaaatgcgctgggaataaaggggtctgcccgccccagcttcccctgctcgttaggggctgagaaaacatactgaagctgcaaaggacactggaaagttttcttttcaaaactcaggtgggggggtgagtattctggcttctgcagtcttggtgccggttccacacgacaaggtagaatgtcaggacagggcagaaagtaccacaacgtacaaggtaacaatatggaacccaacgacagcgtggaacatcacgacaaagtaccaagtaaccagaacgtccaaaataacgacagtgcacgaagtaccgacagggcagaatgtaaccacaacgcagaatgtagcgctaacacacaccgtaaggtaggagccggtcacataaacgccaacagggcagcagacagcaggtgcactgaggatgcggccggcggacacacggaccccggcacctctgcctgctcccgcaggaagggccgaggctgcagtgggggctgagtcgactgcctgggcccacgccgggtgctgcgggcacggagcctgggggaggcgctgcctcctgaagcccagacggcttctgggagaatctctcaggaggaacccaccgtggacgcacctgcagcagcagggcaggaccgcggggcccggcccgcaccaacccacacccataggaaccaaaatgccggaggatgtgaggcgggtgggaacacggcgtccctgagggtccccctcccgccccggccaggcctttggagcagaggggcccagagagcgtgcggctctgctgcgggtggcaggacacaggactggcgtgtgcgggccacacacccccgtcttctgtgacacaagcctctggcactggccggcctccagacacccctcccaggccttcccccttcccgcccagagggaagccggcccgggtggccccactgcacggagggggcagcgcctcacgcactccagacgccccctggggcccgctcaccctgaccctcggcccttggcccccggccacctgggctgcgtcctggcccacagggcacggtctcccctgcagatcagtgtgatcactggctccccgctccgcttccaccttctaaccccgaccccgggagcaagaagggggtttcatctgtcactgcttctccctcctccgtcgggcatcctccctccctcctcccaccgaagtttatgagtgtccactgcaagcccggcacggcagccacacacgtggacagcgggccagccctgtgcgcatggagagctcagccccacgcacagtggggagtttgtgctgcagaaaaaagcaaacccacaaacacaggagtcccgagaataagccctggcagccccgagcagccccacgcggcgggaggccctgggcttcagaacacaccccgtcctggaccaggccccacacggccgcccacccgggtcgagctgcatcccccgagatgtcccaggaccccagcgatgcctccccagcccgcagctctcctggccacccgacaggtggatgtggcctgtccgtcccggcccctgaggacaaagatgcccaggaaacgaccctggtagtcaccaggcttggtgtcagacggtctgtgggtttggacagatacgtaatgatgtgtgtccaccgttatgggtcgtgcagaggagtttcactgccctgaagcccccgtgctccgtctgtccatctgtccccatccatccccctgggacactggtcccgtcactgtcccctagctcatcccttccagcgggtcccctgtggggtcacacaggatggagcctttgtctcccgtccatcgtcctcacagcctcactcatgtctcagagtcctgcaggcccctctcccgttcctcctctgccttccccgtccctcggccccgttgcatcctcctgccccactaccccaatgtccgccaggacctgggtcagcctccaagtgctccaaacagacagaccgggccacgtgcgacagcgagaggcaacagtaagatcaggggccgtgtgacccacggtgggcgtgggcccaggggcaggagtcctgcaagctgttcagacccagagccacacgcaggacggccgcccagcaccacgcgggctcccagggtggagcagacttctatgctgagggcgcaaacctcgatggggctgtccccggggcagcagcggctccccacgcctccccggccagcacagtcctggcactcattgggcgccgggcttccacgtatgacaggctgcacctgctcattcactctgtttccctccttccctgtgaacctttgggaagagatgccctcagtgcagcctgagaaagtggcgggtcctcccctgcaggcccacagcccccgcaaggtggccttacagctggtcccacgaggcggcagtgtggacgtgccacccgagagccgggctgggctgagggg

SEQ ID NO: 20 - DNA, 3877 bp, Equus caballus
cagccgggccagggtggagagccaggggcggcagccaagccagtcacagaaccgcccagcacaagttccacgagctcagaggacgggctcagctctgaatccgggtggctggttacgtggcacagctcaagctgcccggtgcagcacccaacagtgagcgcccacagcagaggaggtggacagggaaccagcagaaacccagcaaaccggtcaggtccccactgtggagtcgccaggtcaggtgaaacaaccactgcaatcccgcttccccagtttctgttggaaactctgcagctggtgccaggacatacgagccaagtccagtagtgacggctggataaaaactgacctaacttcttcaactaaaacatggctaggggccggccccgtggcacagtggttagggttttgcatgctccccttcagcggcctggggtttgcaggttcagatcctgggtgtggacctagaccactcagcagccatgccgacagtgtttgtaggtagaggcgtcgcacatacgaaacagaggaaagtggacacggatgttagctcagggccaatcttcctcaagcaaaagaaaaaggaagttgggcacagatgttagctcagggataatcttcctcaccaaaaaaaagaggaagattggaaacagatgtttgctcagggccaatcttcctcagcaaaaaaaaaagttacaaaccagaaatcttaatacaaatagacaaagaaaatttttcctaatttgtccattcctcaataaacttcggggaaagattaatagttcttcaaactctcaaaggtcatttacgagcgagagagggagacagagagaggaactagtaggcatggagcgtcttgggacggggagggaggaaaccgcgggactggactggccgccgaagtgaggccactttccagctggagaacttcagccccaccgtgtgacgactctgacagccacaccccgtgggagcgctcgctcaggaacgtggtccctcagcacctggactgacaacacatccctgattttctgaccgtgtgggaacagcccaggcccctgtgctcccgacgcccgagccacgggccggtcagaagacacggtcatgagaagcagagggagcctgctgccgtaggggtggggggcagcggctctctgggaacacgcttgtgaaaaacctgcacgtgcacagcgcccacggctcagggcccggggcccaggctgggcacctctgaggcctggcctccttcccaggggtaagttcctgggtggcaacacggacaagacacctcctcccgactccaggctcgtcctgtaattctcgaagcccggagccaaccgttggccagaaaactaagaggtgatttatttcctgtaattgactgtaaataaaataaaacagctattcccaaaaaccggctcagaggcccgtatagagtgcactgtgttcagtcaaccgccaggggggaggaagaggcaccccaggccggcccgcagccccggctctggttgcatctcccggctccctggctcctgaaaaggacaaggcggccaggccacagggtctgcaaggccggctggggtatgcgaggagcgaggggacgtcctcattcctgtgtggctctgagcactcattacagcgcccgcgacggcttcctgctggactgacgcactttatgaagtctggtcctgagtttccaagtttaccttccaaaaacgatttctgaattgcactgtgatgcaagaatgccgtctgcagacaggaaggtttttttgtttgtttttgtgaggaagattagccctgagctaacatccgttgccaatctttctcttttttcccttgagggagactggccctgagcccatccgtgcccatgaatccgggccaccaaagtagagcatgaggaaatttaaccactaggccacagggccggccaccaggacaggaagtctgtgacatttgttcagacttgctctgtggtctaggatgcgacacccaggacaataccttccaaaaatgaaggtgagacctccacttgcagataaaacagagggatggagaccagaattaccgcccgggctaaacttcataaggcaccttaaggagtaaacgatagcaatcttgcacacactcctgcagaaaacagagcgggggacatgattcccaactcattttacgaggccagcgctaccacgaccccaaagccaaagacatggacacgagaaaccaggcggatctccccctgaccgcacacaggtctcacaaagacgtcagcagtcagaacccagcagcacacgaaagagactattaactgtgatcaagtgggtttatccgaggaagcgaggcgggtttaacacccaaaaccaacccacaaaacgccacatcactggccacaagattagaaggaacgtgacttttcatgttaagtgttctcaacaacctaggaccatcaggtaacctcctcgagctggtgaagagcgtctacagaaaaactcataaccaatatcatccttgacgaagactagatggtctctacccaagacgggacacagggaggctgtctgctctcggcacgtccacgatcccagccacagcgctcaggcaagaaaaagaagttacaggggctggcctggtggcgtagtggttaagttcgcatgttccacttcagcagcctgggcttcactggtttggatcctgggtatggacctatgcatttttcatcaagccatgctgtggaggtgttccagatacaaaatagaggaggatgggcacagacgttcgcccagagccaatcttcctcagcaaaaaaaagaaaagaaaagaaaaagcaaaaagaagttccaggcatacagaccgggagggaagcagtaagagagtttttattcccatatatggaaaatcctcagcatctctgattgactactagaactaacatgtgaggtcaacaagttcacaggatacaagactaaaaagataaatcagtagtgcttctagaactaagacgacaattccattcacagtagcatcgaacagaacagcacactccgggaaggctgcccagcgaagagaaaacactgctgagaaaaacaacagactccaaaacgagagtcgctcctgctggaggcctggaggagcagggctgcttccgaggatgaacgggtcgggtcgagacaatggctattgaaacctcagcaggctttacgtaaagctggacaggaggatcccaaaaagcgcgtggaatgcagagaccctccacctcgggagtccacccgagagaaagggaaacgcaggtcctcatgcagactcactcacgagggcccccggcaggattaacagacagctcgaaacgggaaatgagcccaggttcatcgacggggagacaagtgcggcagcgccacccatggacccgcccaggcaagaaggaaagacagaccgagccctgaaagtcggggagcctcacagtctgccacttagatgggaatgcagctggcacggacccgctcctcagtgcagaagacgtcgctgaaggacgtggaacagccgacaccgggggctgcgctgagggtctctgcacatcgtggacacaggggcccaccctgcaccggatgagctccctgaccaggcaggtgctccacagcaggacaggcggctgacgtgcagccatcgtctgtggctgctggagaggcaagtgcctcggcccaggcgtccgcctcggggaagcctcagagccctgtggcggcaggcccgatgaggggccccgacagccagcgtctccccacagaaggctaagggacggcagagacgccgatgcaaatacagcctctgggaagcaaagtcgactatctgcaacagtaaattgacagcgtccagcaatttc

SEQ ID NO: 21 - DNA, 1287 bp, Equus caballus
gatccctgacttcaaaatctactaccaagctatcgtgatcaaaacagcatggtactgtcacaaaacacacaaagggatcaatggaatagaactgacagcccagaaataaaactgcacacctagggacagctaatctctgacacaggagctgagaacatggagaaaggagagtctcctcaataaacggtgctgggaaatctggaccgccacatgcaaaagaatgcaagtaggccattatctttcgccataaattaactcaaaatggatcaaagacttgaaggtaagacctgaaaccacaaaactcctagaagaaaacacaggcagcacgctctttgacatcggtcttagcagcatgcctttgaatatcatgtctcttcaggcaagacaaacaaaagaaacaataaccaaatgggactacgtcagactaaagagcttctgcaaggcaaaggaaaccacgaacaaaacgaaaagacaacccaccgactgggagaaaatatttgcaaatcatatatctgacaaggggttaacctctaaaataaataaagaagtcccaaaactgaactacaaaaaaaaaaacaacccaatcaaaagacaggcagaggatctgaacagagatttctccaaagatatacaggtgccaacaggcacatgaaaagatgctcatcatcactaatcatcagggaaatgcaaatcaaaactacaatgagatatcaccttacacctgtcagaatggctataattaacaggacgagaaataaccaatgttggagagcatgtggagaaaagggaaccctcatccactgctggtgggaatgcaaactggagcagccactatggaaaacagcatggagatttctcaaaaaattaaaaatagaaatacggtatgatccagccatcccactactgggtatctatccaaagaacttgaaatcagcaattcaaacagagccatgcgcccctatgttcatcgcagcattattcacaatagtcaggatgtgaaagcaacccaagtgcccactgacccatgaccggataaagaagatgtggtgtagatgtacaatggactactactcagccgtaaaaaagacaaaatcgtccccttctcaacaacacggatggaccttgggggtgttatgttaagcgaaataagacagacagaggaaaacaaacaccatacgacttcactcatatgtggaagattaactaacgcatggacaaagagaagagaagagtggttagcaaggggaaggcgttggggggaagaggtggggcggtgggcaaagggac

SEQ ID NO: 22 - DNA, 3188 bp, Equus caballus
tcctcactcctgattcccagggtcccggggggtctgcagggctgaaggaggggacccctgctgggtctgctccccggtagagcctgagagctggtccaggaccctggcccttcccactgctcccaaggaggggggactcaatgactctcacccacttcctataagttcttaaaaaacaaaaaaacgattgaggacctttctcatagcatcttatgtacgaacattactctgaaattaatttcccatgtcttggagcgaaacacgtggaagtgtatggaagaacgtggcagaaactgtatctgtcaatagcaccctgaatgcttcaagaatgtcagattttacagccacaccttatttagtgatgcttgtaacagaggaaagcttcctgtcacccacacacattagcacagctcttaacagggtcctcaaagggtaatggctcttctctcaaacatacgaaccgaagacactctgaaactctacaggctaacagaaggttaagaatttttattaccgttctcccctgatgtagctgctccacgttccctcccaccacagagcaacagctacatgttactcctacttaatgactagaaattgagcttaaaattattagtaactaaaattaatttatatttaaatgtagttgcattgaataaaaatgtttgcattacaaagagatttttccatttcttccaaaagcccccaaattccaaagtgcacatttaagtcgatatggacctgctttcccatcggatgtttttgaagcctgggttcatgggaagaaggttgtggggacgtgtgcaattgtaggggaactgggctctgtcccggccatcgttctgaactagttactgggtgcaagacggagttaagaacctgcatttcaccacagcatcctttcttggttctcctttaaatacgaaagtcggatgccacacatcagcaggaacacagggctgagtcccgagatggggtcaaggagaagggaacgtggacggtccaccgaggcaccccggcctgaaccttgaccttttccctcccaggtcatcactgggtgatgaagtgtgtggagaagcagctcatccacattaagctctcggttccctctgcaagaacttactttaaaaagcacactaggggggttggcccggcagtgtagtggttgagtttgtgtgctctgctttgggggcctggggttcgcaggttcggatcccaggtgcagacctacaccactcgtcaccacctgtggcagcaacccacacagaaaatagaggaagactggcacggatgttagctcagggacaatcttcttcagcaaaaaaaaaaaaaaaaaaaagcatgctaagggtttcacaagcctaacatcctggttggtatcactggcctcacactggcctcagtgtgcactctctgctccccaactaccattttccctccataaagacgggaaggagaccttccaagtgccccttcacagaagacgtctgccaaacacagaaagccccgcctccaccatgacctcctggggtgggggacacccaacagcaaccccagcgcgcaatatgagtcattttggggtgtattgtggacacaccctgctgtgttttcacgggagacgtgcctcctcagactgttcgctggggacctaaacagggtgacgacggaaaggcctggccaggcggctcacgctcagtcctgtgtgtctgtgcgcttgagaacgttttcctaactgtgacaatctcttccttgggcccccgggcccgccctccctggcagagtctgcagctggggatggagttttgcaaacactgctttagggagagtataggaacaagctctcatcatttcgtcccgacaggtcctcccggattacgcgcgtctcaaaattcagccaaagcaggccacacactccgaaaacatcaagacgtgtttcagggcgacttcgggtgccagacaaggtggaccactgcttactgaccactcggggacgtttaaggggaaatcacggggtcaacctcaagagaggctcctcgcgctgactcagtctctctggtctgggaaaccgcgaaccagagggacctttcattccgtcctgcctccgccggcaattcctgctgactccatcattcacacccatgtagtcccccaccgctgaccagctcaagcccctgcaccccggtctatctcagtgcccccaccctgcagatgccaagcagccagccacggaaccaagcacagactcctcagccccaattccgtgtcccctgttcctgccatcacgtcacagtcccagctcagcagtgtgcctcccgccatccgactgctctgctctgagcgggactccacgtgtgatcttctcagcatctgaacatctgtccacggaaggtcctccctttgccccctgccctgccccccaaattcagtgcactccccaaaccccacaactcactccctccacatgtctgtctccaagtagaaccggacccctccctgctctgaatgctcaggctggcttgcggctcactgcctgctgtgcaaagatcctttccacgtgcacccaagctgccctccttgcacagagctgacccgcaaatatcctcagtcctaaggggattctcgcaaaggcagggatcacgaaacgcaagatttgccttcctgcatctgaaacacatttaatgacacagcgagcagctctcgcagtaagacatggacacgcccagtaagatgccatcgggggagggaggaaactgccactgctggggcatgctctctggtccccagccctcctcgcagatctggttgcctcagtgcaacgagggatccgggtgagactttgagaagcgtcaggcttccgtgcccatgggtcccggggccacgtgtccctgtggggccagcccagcctcctcctgggcacgtctgagggtctcacccagggggtctggggagggagcttcccattctcctcggggactgacttttgagaaaatgccctagatcccttagaatgtgtcagaaaccacccagaattcagagccaaacgtgcccttagcggccggtccgcttcagttggggaaaccagtgggactgactgccacgcgcaggcttcgcttcatcacggcgctcagtgatgctgctgggatgctggcttccagcctggaggacggcacaagttccagtaatttccc

SEQ ID NO: 23 - DNA, 3897 bp, Equus caballus
ggccagctggccagggggtcgagcattcgcagtgactatccgccgagaacgaaagagaaggcccggcggcgtggaggggagacgccaagagagcatgcgcagtacgtgcccgctgagagcggccgcgcatgcgcagcgcgtgcccgctgagcgccggagcgagcatgcccgctgcggagcccggggaagcagtttttagttaaaactggtgacttgagaccgccgagggccccgttgacgttaattttatttatcaaccaataatgatggcttgggggtgtgcgactactttaagcgctggcctttgaggatgagaatgaactgcatttataattgcaaaaataataaatctcttggaggtgaaatgactgacttaaatgacctttggccccctggctcccttatttcagtttctgcttttaacagcatcgataaatcgtgcccactgcgcacatgcacctctttcctttatgtcttcattttttttttttttttttggtaagatattttctttttctccattgagtttatttaaaaagtggttgggtttgctcccagtcgggggtaattccgaggtcttaagagccgggttctcctacttgcctgcagtataaatatagctggactcgccagatcgctttctttcttgagctatggttttatttcgtgcgtccagcgattgccgcctgggtttgtatttcttgactggcgataaaagcccgggtatgctcgtcgggcaggaattctgcaaagttctttctactaattgggaagcagacgctggtgtgtgcgaggctgtcgtttctggagagccataaatcttggtacagatctctgagtttatcgcctacagacatcttgtcaaagaacaaatgagcttttcactcggggtctttcaatgagcggccgggcgctgctccattcatccgtgtggtttgggggcagaggcctttggcgagcgcttgcacaagacggcttttatacaccagggcacggcggggaggctgaaggtggatctttgtgccgaggccaacgggacagaaataaacggcgggatggacacagaatgcaccttcagtctgtgctggcgggacggagatccggccctgggagcacaaagggccgctgtgaggcccaggggcctgggatgtgcacggcccgcccccagacgggaccaggaggctgctgatggcaggaatggaagctctgagcgtcccatccgtcttccaggggtggccagagggatgggggtggggacaaggagggtgcagggggccaggaaggttctggaggacggtgcatgagatgagggcgggggaaaggggaagctgggtgggcttgttatccagggatggctgtcccttttctgagcccacctgagcccaggtggctcgtgcggctgcagcccaggtggcccctcaaagctggtcacacggctgcagctgctcaaaaaggcaacatgtcccctccgtcccatccctcggaagcacagtctttcccccgagccgcaggtggccgactgcacgctccgacctgggaagcgaagacgccccagagaacgcgccctgtgagctcgcttgtcctgggctgaccctaacgcggcacatacgtggcttgtgcagctagacttcaaaagaggatcaagtttatatctgccacgtgtgttccgcctcagggggtctctttcttctctgtttaatccgtgtttctgtcatgaaaacggactccggaatagccacgaacgtgcgcgtgtttgatttcaactcatttcctccccagagagccgaggagagaggagttcaataaagcaccgtgtctgggttcttttctgatgatgctgtttacgaattccgcctgcgtgaccttcccgtcccctgtttttatttgcgtctctttattgctgatggatttcctttgcaacatttggtttcgtttgtcgcctgatgagacttcctttcgcacgattttaaagtggggggatctgctcttttcaccgtgccgaacctcgaaacgtcccaggacgtggcacgggcgtgtgcgagcccaccggccgtggagttccggtgctgaaggctgcatattgcgttgttgtcgctggaatgtctcctttgaaccacggtcacccctgcaccccattccttctgggtctcatgcatctcagacccccgcccaccgctttccccttgattagaaccagagtgtttctcggtgctgggtttccagcgagagcaccgaggctccaacggcctttgaaggtttttttcagcaaagacggttttatggtcattcctcatgtgccagggtttcgctgcagccaggacaaaaagggagggaaaaacccattaaaagttttctatctaagctgccgcattttaagtaaaacgccacgggacctggcaattgatgaaaataattttgttagcccccatttcgaaagctttaaaggaagaattaagtgtgtcgaacaaaagaggaaaaaggaagctaattcacagccgttctaaccaaactaaagaaaagaaaaatcctacatgataaaaagaaaaaaagatccaggggggtcttcaaatgtaaccttttatggaggttctgcgtgcgcgtggttttttactgtttacgatgaacgttttcggacgtggcttattttcttggttcgatagcccagttttaatcgctggcttgtgggggctccggaggtcagaggtcgtgggtctgtgtggtacccgtccacgaaattctgcccctttgtaggttctgggtctgcttcttattgtttttgtacagctttgggccgaacgcttgtgatgacctgtgacttctcgcaatccgcttgcccgtctcgatcagtctcttttaatcgacctagaaattatttattgtgctggaatgcagcgtaattaaactggtggctattgggtcttctgagtgtgcgttacaagcccggggacatagataaataacaggcaggtcgcgatctcaaagatttcctggtctaatggggtgggagagggcaattagataattagataattcagtaattcaaagtgcggttacacagtccgatgtggaaggtttgtgatagagcgacaaatataggaagaaatgacagaccgagggagggagcatcacctcgtagagaccgtgccgttgaagccgagattttaaggatgattaatgctggaaagcagggtgcatggcagacacacacagcagaggcagctggtttggaagacggtgtgagtttctattgcgagggcatccgtgtcgggcaaacatgttccgagtttcccgtgtgcacggtaaacgaaatcaggaggctggaaaaatagggatccgcattacgttggggggaaacctgtgataaaacttgtttgcaatacgttggaggcgggaagtgtgcccagcagccccggatgagttcagacaagaacggggcagatacaagcagatttttggaagaatatcggacagcccggaaagggcacgggtggaaaatgagtggcagggttttgtaagccgtcggaagtgcccgttaccacacggcctggggagaagacccagtgcgggtttagtttttatttttcttttcttttctttttttttttcttttgaggaagattagtcttgagccaacatctgctgccaatcctcctcttttttttttttttgctgaggaagactggccctgagctaacatccatgcccatcttcctctactttatatgtgggacgcctaccacagcatggcttttgccaagcggtgccatgtccacacccgggatctgaaccctcgaaccccaggccaccgaagcagaacgtgtgcactgaactgctgcaccaccgggccagccccccagtacaggtttcatccccttggtgaagacaggtgagagaatt

SEQ ID NO: 24 - DNA, 2638 bp, Equus caballus
gaaagggaagccatggagaagaagggcttcctggagggaggcggcccctgaatcaaagatgagagaggagggcctccctggagggaggcggcccctgaatcaaaggatgggagaggaagggccttcctggaggaagccggcccctgaattccaaggatggagaggagggcttcctggaggagggcggcccctgaatccaggatggagaggagggctttcctggaggaggcggccctgaatcatggatggagaggagggcttcctggaggaggcggccctgaatcaaggatggagaggagggcttcctggaggaggcggccctgaatccaggatggagaggagggcttcctggaggaggcggccctgaatcaaggatggagaggagggcttcctggaggaggcagccctgaatcaaggatggagaggagggcttcctggaggaggcagccctgaatcaaggatgcacaggagggcttcctggaggaggcggccctgaatcaaggatggagaggagggcttcctggaggaggcagccctgaatcaaggatggagaggagggcttcctggaggaggcagccctgaatcaaggatgcacaggagggcttcctggaggaggcggccctgaatcaaggatggagaggagggcttcctggaggaggcggccctgaatccaggatggagaggagggcttcctggaggaggcggccctgaatccagggacagcgtcctcctcagagacagaagaggagacgcagacgcagaggagcagccccgtgaggacggaggcagagacgggagggaggcggccaccagcccagggaccctggagccccggacgctggaagaggcaggagggaccctcccctggagcctccggagggagcgcggccctgcgacccttgacctcagactctgggctccaggacgggggaagaggagacttggctgcagcatttaaggtgctaataacggcagcgggaccagcgacgggctcccgcgcgcctctgccaagcgccccaaagggcaggatggccaatgtggggtctctgtcgcccgggggtgtacgagggggcctcgagagctccgtggcggggtctgacttttgcacacgggcaccgtgcacacatctccaccccttctaactcgacgcggctgctccccgacccgtcggcagccaacccgcagccccgacaaacccctctttgtcccgcacgctcccctcggccgctggttccgagaaataagaggtaagttgaaaaatgcgccttttttccaccgtcttcatctctaattgaatcctctcccgacccccccgccccccggctccccacggcgccgtttggcctgttttgatgatcaggaaaagaattctgtatttgggtaataaaattttcttcgtcgccgtcagcaaccttcaactcaatttcccgtccccggagacagtgtctattagagaatcgaatcggattccttattcatagggaaaaagttccaatttaatctgaatattcagcgctgtggtcggggtgatggatggcgcgtggaagcgatcccggtggagggaatgcaggctcggcgggcgcccgcgatggaaggaggtgatgaagtcggatccatctgctcaccaaagtgcagagacgcacattaggccgcgcggacctggcttctcatttccttcccggctggaaaaggcatcaaacggggtcacggatgcagaatgaacgcacgtgaggcagggaaaaacgcagccgccgtttaggccaacaaatgggggcacacggggatctccgtcctcgtgagagatcggagccgagggcacgacgggggctccgagggcgagaacttggggctggaaatggcccgattcgcagcctggagggggagacggtgggaagcacacagggcgactccgtgtctggctcccgggacgcggtggggtttggcgtcctgagggaggatggtgcccggggtccgtgtttctcatgaggagcccgtgcggagcgggttttctgagggtctctgacgtgcccggaagtcggtttgttcgctgctcacccaacgggagacgatggagacggaggagcagaggccccaggccctggggagggacgcgcgcatttctccactgacagacgggaggcgaccgcagcctcccagatgcgaaagggggtcgactccgtgctcgtgtgggctggacggtgcagcagacccctaggggcccggacacggggctggaccgtcaggacgcaggggacctgggtgtcagggggacctctgcaccccaccacccccctctgctctcagacgtgacctcatggtgacctggacgtggacgtggccctgggtgacctgtgtgacctcacggtgacctggacgtggccctgggtgacctctgtgacctcaccatgacctggtcatggatgtggtcctgggtgacctctgtgacctcccagtgccctggctgtggcccctgtgaccccagctgcacgcactttttcctctgttcactgtctgccggctgttcctcactgggcgcaggcggcggcccacccgtcacactcccctgggccggctcgggggcaggacggcaggaggggctgtgcaggggcccgcgccgtgctcccagcctccctcctgg

SEQ ID NO: 25 - DNA, 1261 bp, Equus caballus
gcggcccggggctcctcggagactcagataaacgaccacatgaccgtgcagacaagactatgtttttttttttttaatttggggctggcggggtggttaagtgcgcatgttctgctttggcagtctggggtccgggggttcagatcccgggtgtggacatggccaagttccacaagccatgctgtggtgggcgtcccacgtataaagtacaggaagatgggcacagatctgcgctcagggccactcttcctcagcaaaaaaaaaaaaaaaaaaaaaaagaggaaaagttcaatgtgagtcctgagggccaaccagccaaggttaaggcacgatggggacgggatgcgacctgaagggcacgaggccacaggacgggctgccttctccgtgctctcccgccacctgtgtagaccaggcggccggcccagcggcggcccagcccggggctcctggtcgggttctgcctgcgaggaggagggtttatttctggccccagcgccgggggagggggtggatttcagggtctaaaagcgtccccacagcctgccgccggcacctgccgggcattccggggccgtcactcgatcccgggccgccgagcggctctattttgggccgcagctggaggcagggtgggaggctgcggctttgctattccgggtggaaagacggagggattcctgcggcccctgcctcaccttttttttttttgagcctccctccacgccctaatttttttttttaagtctggccctgagctaacatctgtcgccaattttttttttttcttccccaaagcccccctggtgcacaggttgtatattctagtggtggggtcctttccagtcgtgcgcgtgggaacgctgcctcagtgtggcctgatgagtggtgccgggatccgaacccgcgaagccctggccccccgaggagcacacacgaaccgcaggactcggtcccggccggtccccgtccgaccggattgttgaaccgaagcacgtgccacgggactcctcgtcttaaagggacaaagtgatgccgtgcgaaattgtggcctcaggacctttgcacagtcccgtggactgatgccgaggatgcggaagcgaatggaaggggccggcacgtttggaggcgaccacccagccctgctccccgacttcgtttcgaggtatcccccccaccccgagtcttgggggggtcccccctgcctgcatcatggattttcctgcatttgtgaaccctccttgaaaaccgacttctgtcc

SEQ ID NO: 26 - DNA, 23758 bp, Equus caballus
acggcgcacggcgcgcaaactgcccacccgccgggcctcttctccatccgcgctcggggcgggggggacggttgcccggaatgccgactgctctccggagcccaacgaacgacccggatccgccgcagctgtttccttgcggctccaaacggggcggactcgtttcataaatagaagaatgttttaatcaagtcgcaagacgggacgtataaactttattattgatcccgcgtccgtgaaagcttcctcaataaaccaaacccgcttccctctcgcgggtttccgggagggaattcaatctgtctctcactttatatcgtttttctttttttcctactttttttatggcttcataatccagggcgtctttgtagccgcaaattgaatagcataattgtttcttttctttccccggatgaaaatgtgcttttggttggaggaggtcgtaactcttgacaaaacgtaaccgtcttaatgggaaaaagttctaccaaaaaaaaaaaaaagaaaaaaacgaaaaaaaaaaaccgcttcgccgacatttatgtccctcttttgatctaaaacggggccgaatgggtgaaatctgtgtttcaaagtaacaataaagtgcttcgtcgccaagaggcttctgcaacagttacatattttgaatgaaacattgttcatttcttgcaggacattttaattttgttctcggttacaatgttgcctttttttaaaaaaaaatctgaaagcaaaaccgattcaggggcgactctgttcgttttgagggtgggacaacggtcggggtgtcgggccggacagacggccccggttcctctcctgtcctcatcctgggcccgttgagacggttcgaggttttctcggcgttcgttgatgagtctgcaaaaacgaggttcacggggatgaggccacgggacgcagagtccagtttgggggcgttcggatggacgcacagtcgggcctccaacaacacagtccattgcagagcgtggtcatcaccccgggtacagaccccacatccctctgccgtcacccccgaaacctgctccaccagcccagccccgggcagccaataattgactctgtttccgtggatcggcctgttcgggacattttacataaatgggatcccacgctgtgtgtccttctgtgtctggctgctgtctctgagcatcatgtgttcaaggtccatccacgtgtagctgtgtctctgctttgctcctgttcatggctgtgtaatattccacccacaatagcaggacttcagtggatccttttggggatgtgagtcgatccattaacgttgcttgatcactccgtttggcattttgggaccatccgtgggtcaaactcccccctcccccgttttggtcggtgctgcttcttcccgggacgcatccgtgggggtccctctctgttcctgccccagctcctgagggtccatccagtgggatcgggttcctggggtctagggacattctcactcctgtggggaaccccgagaaagcggttggggccacggtgttggcggccgccccgtctaacgtgttcttcccgagggagaaaacaccgccttccaggccctggcagccgggctggggggacgcagctggcaggtgggagctgctattcccggggtccccggacccacactgcatacatggctgccgactccgatgtgcaaggggccggccctgcaggctgcagagctggacaacgattgatgctactcgaggccctggggacgggaaggaaaacacaggtgggaagtggctctggtgcttttcccgtctccaccgccgcctggccaccccgctctgtgcgggtcagtgaacgtttgttgagcgtctgcaaggcaggagacagacagagagcaagtagacaaacaaaataatatataagctgacagagggtgactatacaaacaaaataatatataagtgggcagagggttagtagacaaacaaaataatatctaagtggacagagggcgaggaggcaaactaacatatatgcctcgcagacctggggacaggctcagattccattaaaggacagagggaaggaggtgttgtgggtgcccagccgtccgtctgtctgaccggctcagggcacgtggaccccaatcccagcccctcagtctgggctgggttgtctctgtgctggagcccactcaggcgggaggtgggaggtcgtggcgttgacctcccatcctcagaggtggccctcagcccacccagctgtcaccccctccccagccgggtgggtccactcgcccccctctgtctggggatcggcctgttctggacatttccagccaatgggatggcacgctgtgtgtccttgtgtgtccggcttctgtctctgagcatcgtgtgttccaggtccgtccacgtgtagtggtctcagggccccgctcccgttctcggctgcataatattccaccgtgtagacagatccctttctgtgtgtccatccacccgtcatggacgcccggctgttgtgatcagagctgccgtgagctctcctgtacaaatacttgttcaaacacccatttccggttaatctgggcccacacccgggagcagacttgtcaggtcgggtggcaattctgtttaattctactcactccctgtccacttatatattacttggtttgcctacttgctgtctgtccacttagatattatcttgtttgtctactcactgtgtggttatatattattgaggaaccgccgaccgctctccctcctctgcccattggacccgccctgggcccagttgtgcgggcgcctctccctgtgcttttccctcggctgtgcatggcgccccgtggcggggtctgcctctggcctcagccgctctcactgccagggtctcaggggtccgggcggctttctggtgtcgggcgccccgttgggatgccccagatgaaagcaggcttcggctcccgagtttcctcccctgtgactcagtttacccgcttggcgcccgggagtggaggatgtaatcatctatgtctctatcatctatctgtcaatcatctcccatctgtcaatcatctgcatattgcctgcacacgttacacgtggatttgtacccgtatgtgcacacgtgcacttgaacacgcatgtgcgtaaatgtgtatgtttctgcgccctttgaccccagcttgcatgttctggaaccttcctgcgcctccgctggcccccgccccccacgccccctgcagctggggtggcccgtccgcgtgtggccacagggtggcggtgcggcccagggcacggcggctccgagtccgacgccaccgggtttctctccttttttctccccgccggccgtgtagacggagcccggagccggggtcagcgtctgagggtcgtgactcggccgccccggttgctgacccgccaggacctcccgcgaccccggctcagactctcaggccgggcgtcgcctgcacgggtggctttttgcggtttcctgagaaatgaggaaaaatccactttgtgcaggattttttctgcgtctcctgctgcatctgacggacgagctccgcgtggagtttggggcgaggcgggtggggtcgtgtgcaaacagcaggacgggggcctctcggcagggtcgacagctgtcaaggccgcccggagacacgatgccccagggtcacatcgactgggaataaatgctgagcccccagagaaaggaaaatggacaggaagcagctcaggttaatagactgacttataaaaatcagatgcatcgaacgccgggagtgtccacggctgcgtaaatggagggacagcacatggtccgtcgtggagggaatattacatagccatgaaaaggaaggagattcggacacgggctcctttttcatggctgcgtaatattccaccgcacggatggaccgcattttgctcattcgttttcggtctcatttattccttctgcaaacagcgctcctggaagcggctggatcgccgtcccggggcgtgggcgtccgttttcgtgctttcggcaccgagggtggggcgtcggtttttgcacacagaaggagacaagcagatgtggggaccgactgggcccttttgatggcggtttcgaggttgggaggtaatgctgtccgggagtcggtttgtgacgggtgatttgggtcggtcgggtcctgcgtgtctgaaggatggtggtcggacctcagaggcggaaggaggaagagcccgccgtgccctgtgacctccccaccaccaggctcgtcaaagggggacgcagcctctggctcaagacccgagtcatcctttgaatcagagatcaggtttttttttttttttttttgctgaggaagagtggccctgaatgcacatctgtgccgttttcctgtgtgttgtgtgtaagatgctgcttcacgtggtttgatgagcagaagaggcagcagggaccctccccggaggccccagagcgacccgaccccgcgacccttcaccccaaccagctccaggtccctcccagaggccccaccccctgcgcccgcctcggtccgtgtgcaaatgagcgtcacctgccgcgtggcccgcgaggccctttgatgtgcggccgaccccgcgggacggtgcccgggaaacggctcgggaaacggcaggcggcttaattgaggcgaacatgaaagctgccgccgcgttaattagggccgctcggcccccaaccgagtcaggactcacatctttcacgcagcgagctgggcgttcatcacccccggacgccgagcgctcggccggggagccctgggggggggggcccgggtgtcgtctgcctggagataaaggaatggggtgtgagccggggggcgtctgcgtatcagatgccggagggaagacggggtttaggggaatcgctagtggggggcagtcgcctccggtccccccacccgggtcgtcggccgccctgttggggctttcaaggccgctcgggggctgggaatcagggttggacgggtggggcggagtgcaggtctggagagttccaggtgacgggccattcaggggcttgaaccccagggatccatcctcccccatcctggagcctagagtctgaggtcaagggtcgcagggccgcgctccctccggaggctccaggggagggtccctcctgcctcttccagcttccggggctccagggtccccgggctggtggccgcctccctcccgtctctgcctccgtcctcacggggctgctcctctgcgtctgcgtctcctcttctcatcaggaccccagtcccgttgcatctggacctcatttcacctccttaaagagccgtctgcaaatcctggcacgtgccaaggtcctgtggtcagggctccaacctgtgagtttggggacacagttcagcccacaactgggacgtggggtcctcacggcctgtctctggcttcaaggactaagaggacggtggcagcccctcagggggacacgggaagggacacacagcccccacttcagtccaaggccaggcaggggtctggggtctggacggggtgggtctgggctgtgggtccatcagtgagctgaggcctggatccggggagatgggtcagcgagcagccactagttgggcctggatgttgggagcgatggcaggcaccaggcagccagttttggcgcatgaagccggctcctctgaattggaggcggatgcacctgaggcctagtacctgctctggggtgactgggggggggagatggtggtgggcgtggggtctggacgaagggctggtttgcgtgttaaaggaaggagctgacaggccctcctggtcacacagcaccgctcatcaggccacgctgaggtggtgtcccacacgacacaaccacgaggacccacaacgaacaatatacaactatgtcctggggggatttggggagaaaaagaaaaaaaaaagaggaagattggcaacatttgttagctcagggccaatcttcctcagcaaaaaaaaaaaaaaaaaaaaaaatccagaaaataagaaaacagctggtacagactcacagagggtggggtcgtcgtgggacacgcggaggggaatcacgcactgaaggtttgaaaacggacccaggggaatcgctggtgggggggggtctctaggatgtttgcacaatgatgcagccctgggaacgtgtcgccatcattacgtggtacgtgactgcatctgcgatggttatagggaataaaaaagtgctgtaatccgaaggaacgcagagtcccggtgaggctgttcaggaggatgccgacagggaaggaacgttccggaacctcctgcccattgaaatgtgtgatttttttcttttttttttttctggaggaagattagcgctcagctaacacctgcttccaatcctcctctttttctttattttgttttttttgctgaggaagactggccctgagctaacatccgtgcccacttcctctactgtatatgtggggcttgccaagcggtgccacgtccacacccgggatccgaacccacgaaccccaggccgccgaagcggaacattcgcgcttaaccgctgccccaccaggccggccccagcctgtcaggttttcttttagggaaaaaggaaaaaaaaagaaaatccaggcagccagaccccctgccgcgccccccgcctgcccggctgccttcagatccgcgaggcccagcgggaggtgacacccgcgctcccgccccgcgctggcggctgacggatgactcgcgccccggcggccgcctgggagggtccgggggaggcgggtccacactgcgcgctgccgggcgggtggaagcgggtcccggcggggccgcgtctgctccgtcctcacagtgacccgaatccgtaagcgaggcaccagcgagatcagaggagaccctggcggggcgatgttccatctcggggccgacttgttcccggcggtgtagacgcggccaggagcgcgagtgaggcgggggcgacgctgtcaaacgcacgtgcggcccgggaaccgcccccgggaggagggaagcgggtgggggggcgccccgagccggcggcggttctgggtgcaaagggcgacatgccgggcaggggcgtctacacggggtctggggcagcaccggccagggcggtggggtccgttctccaggaggttccaatttgcacactgagtcctgggtggatgccaagctctgtgagggggcggcatggtttgtggacttttttttttttttttgctgaggaagattggccctgagcaaacatccgtgcccatctttctctattttgtatgtgggacaccaccacagagtctcttgatgagccctgtgcaggtccgcacccgggatccgaacccgcgaactgtgaggggctggtgctctgaccgagctgcatggacgtccgggagctggaagggtcccgtgggaggcagctgcgtgtgacggggaatcagagcttgaggctcggggctcctcgggggcgtctgcacaggacacgcgtggggaccttcacacacgcacgcccacccacccgcaacccagctctacacacacacgcacgcacccccgtcccctgcatccgggggtggagctgggggcggcgagcccgcggcctcaaggacgtgcaggggccctggggccgccggtgacggacgtgcaggtgtggacgccgtcgagacgggacagaccgcacgtgtgtctcagacacgagtgatcacggccgcggacgacgagacaagcgctccagggccttttccccggctccgctcagaatgttaattttcttgttttttgtgtgttttcttttttccacataaaaggtcctgacgctgttccatttccgtgcttgacatcgtcaattttttttttttcctggactttttgtgctatcttgttgttttcctgcgtctggctttcgaccggcccaggaggcagcactgactaattaatttttcacaacgaaaataaaaaatatataaaggaaaaatgttgaaaagagaggagctcggagcacaaatgcttttgtgcatcctggcgatttttttttctccctcgtcttcttttttgttttttttttaaatatgtgattcttcctgacaacttagggagacttacggacttttctaaagtcgcacgactggattccagcccaggcctcactgagcgtcggcggctgtgcgggtgtgagcgcatctggggccacagggcgcgtgcacacaacgccaggccacgcgccaccaggcgagctagtgtgttaatggtgatttcgtgtcttttgtttggttttcttatcgatttgtctgtttgtccctccatccatccatctatccatccatccgtctatctgtctatccatttatctacctctctatcttttctaatgtattatctatgtatttaatcatctttttttttttttttttttgctgaggaagactggccctgagctaacatctgtgcccatcttcctctatcttctatgtgggacgccgtcacagcgtggctgatgagtggtgtgtaggtccacgcccaggatccaaatctatgaaccccaggccgccaaagcagagcccacaaacctaaccactaccccaccgggccggcccctcattcacctttaagaagcggattaagtcgactcacgtctgttccaacgacccatgtgtttggtcgcaactccgtcacattattttatgtcgtaactcgtgtttgcgttatgtcgtatttcctgtttacgtccatatttggtgagctttccttgtagtttaaaagttttctctaacatttaggaagtttgtgtttttcttttgggggtttgcgttgtcaagtgaaaagcaaattcaggggccggcccggtggcacagcggttaagctcgaatgttctgctttggaggcctggggttcacccgtttggatcccaggtgtggacctacacgcccgttatcaagccatgctgtggtaggcgtcccacatataaagtagaggaagatgggcacggatgttagctcagggccactcttcctcagcaaaaaagaaaaaaaaaaagcaaatttgcctgttattttatctcaaaatgagtctatttgggaatagcccaaacaattgcaactcaggacgggatgttacgtagagtcatagacaaatccggagaagacgggaagagctgcttttatagagaaggcagggggctgcgctaaaggaagggcccctggggagaggaacgggtcagggcagggcggctcctcattggctgggctgcagtgtttctgattggctgagctgtggcatttctgattggctgagctgcggtgtttctgattggctgggctgcagtgtttctgattggctgggctgtttctcattggctggctgagctgtttctgattggctgggctgtttatcattggctggctgagctgtttctgattggctgggctgtttctgattggctgggctgttgccgggtggggagagcatcttcccaggtgcctcagcggtacttcctgtcggagatgcgagtcgggatgtcttcctgtctggggtgattgacaggggagggcgtccagctcagctcaggtttctcttctgagtttccgcagtgtagacattcctcggtgtcccctgctccccccgcctctccgctgctctaacccggctccctctggctggtcagcttcaactggcgcccacatgcgtggtttggacgcccggttgtcccgttgagcccgtgactgtcacattgcacccaccgtgcacgtgggacgtggagtctgccgtgcggctgggactcgggtaccactcacatggtgtcttgaagtcgatcagccaacgtgggccctcgggatctggggacaccatcttccatgctcctcttgcacagtgcgcaacatggtgcaccgagccgtgcgtcccgtcctttctgtccgaaacgctgtggcgcgtgtggcgtctggtgacggcagctgttcccggggagccggccccggcctcgcacccttgggctcgagctcctgttctttccgctccatttgtgcaggggccgggcgggcgctgccgtctgtcaccccaaatccatcctccggtgggcctcccccggcctcctgccccctccgagcccacgagaccatgaggatgggtcgacctgggccgggcacgctcggtttgggtgcaaagactcataaaaaagacaaaaaaaaaaaaagactggttctgtgtcgggcttcagccagcagaggactctgcgggcacagatatgaacagagacgactccacgtgcacagcccagcggggccgggtgctcggggacagtcgggatactggaaacgggggtccttggagattatgctgaaggccctgccccccaggggacactcggcaaaatctggggacattcccggggggtcacatccgggaagaggatgctgttggcatctggagggtgaggaccagagaggctgctcagcttcccacagcgcacagcacgcccagcatcggagcacggtccggccccagggtctccgctctgccatcgagctgagtctctggtgacgtccacggctcgtgtcgtcagcaaggtaacgagaagtcgatttgcaaacgcagcgctgtgcgccgcctggatgcgtcctgtctcctgggtgtctctggtcttttccacgccggggacgtcccctcccttttttttttttttgctttataggaaaatgcagaaggaagtgagcaccacgcgtggtgggacctcaggagcaggcggcagagttcacaccggggccctgggctggggaggcggctggtttgattttggggaagaatgaggcggttttgggtcacacggttgtgaggactctgctgagacgcccgtgacacgctgattgttttcctgacattcccgccggcccgtccccgacggccgtttattttcccctcgccccacacgccccgccaggccttcccccgcatgctgccccggacgtttgttgatgactgctcgtgatgtttactgacaggcccgcgtgcgcgtcagggagctgcgtgaacgcggctgacgggaccaatacacagcaattacccggtggaatctgagcccggggtcgcggcggggtggctgcggggggtcaggggtcaagattgtgtgacgcccatgtgtccatgtctctacccgtccatctattatctacctatctgttacctattacctatctattgtgtatctatccacccatggaaatgcggcggctccttcggggggtcccccggaccggctcgtgtccctccgcccagaagcacccgcgtctggaggctccgcgccgagacccggggtgtagacggcgggcggcgggtggctccatggagtgggcgcggctgaagctgtgcacgcgtgtgtgggtgtacgtgtgtctctgtgctgcgtgaccgtctgcgctcggggcgctttctcctgtcgagcgtgggcatcgcagtgttgcagtcgacaacatagacaacggtgctcccgcaaagtcggcagctgcgcgtttctggggctgctccgctcgcagctttgggggcggaggccgagatggcgcccggggagcgacagtcggggggtctccggggaccccgcaaggaaggcgcaggaggggaggcgggatttcaatcctgtttcaccctcggggtccaggagctgcagggccgcgtgcgatccgtggagcgacgtgtccttccagggcgcccctgagtttgacgactgactattggacgccgacctcgcccgtcgtcactccagcgcttttttcggttcttctgaccgtttccagaagcgtcacaggagccgcggctggaatgggaaaccggcctggtcgcgggattgataaggtgattgttcagtccgggagggttttggggccgcgtgaggagttagcctgtcccttgaggggtccatccagaattgggggggatgttgcttgttgtttcagccttgtgttttttttttttttttgctgaggaagattgcccctgagctaccatcctttgcccagggcagccccttgggtcagttttgttccgtgtcctcccgcgaggtggacaaattccagccggcacctgcttaggtgcggcccacccacgacctaagagtgcttttacatgcgtcttggcgacagagaccgtgcagtgtctcgatgctggattgtgtccccaccctccccgccccccaaatccagtctggggtcaagggtcgcagggccgcgctccctccggaggctcccggggagggtccctcctgcctcttccggcgtccggggctccagggtccctgggctggtggctgcctccctcccgtctctgcctccgtcctcacggggctgctcctctgcgtctgcgtctcctcttctcatcaggaccccagtcccatcgcatcaggacctcgttttacctccatcagctccttaaagacccatctccaaatcccggcacgtgccaatgtcctgtggtcagggccccagcacacaaacaccgtgggccacactcatgacctcattctggaccccccgtgggaagaggttgggttcagcccgttcataggtcgtcctggggctcagccggctgcggggtgttgtctcctctccgtgtggggcccccgatcccaggaagcgggggcccggcctcatcctgcaccttccttgtggctggaggcaggtcctgggggtcaagtcagggcaggaggaacagcccgggtgccacggatggacagacggacagacagaatgggggtccatgcacccagtggaatattacttgcccatgaacaggagtggagccctgacacagctacacgtggagggaccttgagcacatgatgctcagagacggacgacagacacagaaggacgcacagcgtgtgtccaaaatgagcatcacccttgaaaatgggtgaaatgctggagtttatgttaggaaattgatggcggatttccactcaaagggacggggtcccggggtccctgggctcccgccgtctgctctcggtcagagggacagcctcccataatgctttgtgtgttggttggccagttgggacgccagcctctgggggtgcaggggatgtcaggggtcacttttgaactatgaccccgaggatgagctataaacatgtgtcatcagccgcacgagggagctcgttacattgggccccatgttcggacgttctgggtcattcttgatgcatttgctgaactccatcaaaaggattgattttttgattttttttttttttttttttgctgaggaagactggccctgagctaacatccgtgcccatctgcctctactttgtatgtgagatgctggcacagcgtggcttgatgactggtgtgtaggtccacacccgggatctgaacccatgaatcccgggccgcccaagaagagggagcaaatttaactgctatgccaccgggccggcctccaggattgatttttaaagaggaaaaaaaatagagccccattctggcaaaatgccttcccgcacggcccacccagggcttccagagagttcgtgaatcgtgtcagaaattcctgtccctaaagcaggtttgacacaggtggatgccactgtcattaatttgcagcggcccgcacgggcacctatgaggtagcatccgccctgataactgtctgctaaggaaacacaatgagggagccgtttctcggcctcatttccgcagccccgagtccgggacgcctggcttatactcgtgttgcacagatttaccgttttccttggctgtttccgaggaggatttgacagttttctgtaaattatcataaattcagtttccccgaaatgagtccgtccgtctgagaaacatggggtctcgagtttttttttttccccctgagcacaaagtgagccgtcagtggggcatttctgtcaggctacagggtggatgccaaacacacgtccaaaggtcacaggactcctgcaggccctggctgtgcagtggaagacctgagcaactgtgcatggagtgcgcccctgaaattttttgctattggatgttttccacatgcttttacagctttttcctcctcattttcttcattccgtctccttttgtatttagttgattttttttttttgtagtgaaattttaaaatgtgttaggacaggaggtcccgtcgggggccggtccttcagggtggctgctccagcgagcggctcagtgatgaaggcgcgaatcccgggtgcgagaggacacgcacacgcatggggagccctcgccgtcccgtgtggccataatctgcccctttgctgtgtgtctgtgagtcaatcaacaaccactcagggctgaggattaagccggttggtttaacaattagcaggagctggtcaggcgctgggtccacgagggatcccgggtttgtccccctgtgaccggcccaggtgagtggcccgagtgaggacgtctacacgggtctgtttctgggcaggtgaggcccccccaggccccacagaggaccctgcagacgcccgagtggcccccgcgctctgtgctcagctgccggctggtgtacggcccacacccacccgccccaggacctttgcacgtgctcctgctttgtctgcaaggcctcctgcaccgagccaggtctgtctcagggtcggctctgcgcgggggtcccactgggggtgaggggaggtgtgtgacccctgaccctgcggggtggacggaccccgtgagggtggagggatgggacgtgtagaccgagccgggttgggggaggagcgtggacccagtggggtttggatcctgggtgtggatccgggccccgaggctggggcaggctcccacccacaaaatcgaggaagacggcctggatgtcagcttggcaacaatcttcctcaaggaaaaaaaaaaaagggaaaatctgccacagatggtcgctcagggccaatcttcctcagcaaaaaaaaaaaaaaaagaaagaaaagaaaagatagagatgcacttagctgcccctttgcggctccgtggagacgacccctccaggccgggtgggccggagatttctgggctgctcctgaggggggtggggacccgccgcccgccttgctcccggctcagggggactctggctggaggatcgagtttcacattcctgagcgctgagccggattccagggccggagaaaggaattcgggggcggaggcgggggaggggccgccgggagcatcgggcctcagtggggccgtgtgcaaagcggcctcggacactgtgcgtgtacatgtgtgaacacgtgtgcgctgtgtgtatatatgtgtggctttgtgcatcgtctgtggaagtaaaataagatctctcttttttttcttttttgctgaggaagattggccctgagcgaacacctgttgccaatcgtcctctgtggcttgaggttgcctcgtgggacgcaggaacagtccagggaaacaggatccatagggggtgtgttatatgcagacatgtctacactcgcggagagaaggggagacccagcacaaagacttggttcgcctggtagggaggccgacaagtcgccagatgtgcagtcggcaagctggagaccaggagagccggtggtgtagcctccaggctgagtcctaagggccgagacccagaaacagccggtggtgttccttccgctctgagggccagcgggcgtgagtggaggaggagctaggagtcgggttcaagtcctgaggcaggaaaaagccggggtcccagttcaaaggctgcgggaggaaattcccgctccttcggccttgagtgcagtttcgcaccttcaactgatgagacgaggcccacccgcgctggtccatccgaaggccgatctcttccagaaacagcctcccagacgcccccggaatcgggctgagccacatatcagagggttcgagtctcggctggtccaccccgaggccagggttgggggctgggggtcggcgtctggcctcgtgcgcgggggtttcagggaaaaaggttccaccgagagaggcagcgacgcacgacaggcttctctggagccggtggcaggaggggggacgtccttgcagcctgacaccagccagaggttcatggcgagggcgccaccccgaagaggggaggcagcaagggccccccgaggacgggatcagagaggggctgccagtctcaggggtgtcacccagcagcccaatggggagtatctgggtcagcttggggttttataaccttgaggccaactgtcaggtgcggttcctgtgccctgcaaattaggcagggtccaaatggccagaatcctccccgtctgggctgtttttaaacaatttccagtatacaaatttgattttggggccggtagtgttttgagttgacagatctcagcctgaagtcaggaaataatcataatcagtagaaataaataaatttgataaataaaatattgacgtattattttcttttacgtttattttttaagtcccccctatgaagcagtcagttcgcatccccctctcttctcagaccctgacaggcgcccgtgtgacgtgcctgtgctgggcgttgggtataaacgggatccacaccctgtgggattttgtgtctggttctctcactgagcatcgtgtgttcaaggatcatccgtgttgtggcgtgtgtcacggcttccctcctgttcacggccgagtaatattccaccgcaggggtggcccccatcctgtccatccgtccatccgcggacactcgggttgatcctgccctctgccgattttgcacctaatgtggccatgaacccgcgtgtggaggctcccactgcgtgttgaaaatccttcctgtgagcaaaagcaacgacaagagcagggaaaccacccgccctgggaacagccatcaggaaatgctgctcctgtttgagtggctaggactttcctgggagactcagcgatttgcaccccaccccacgcccctcgggcggaaggacggtttcaagctggaggccgtcgagacgtgaccgacgcagaaaggaggcttctgggagcgtcctgagctctcccgtgtgtgtgcgggcacggggcacgcgcgataaatttggtttttctcttctgcatctgctttaatttgcaggcctccgtcactgcacctaagtgggtagaggaaacgtttttttctgtgctccttggctttggtgggtcggtcgtttctgctcctggaatcctggcgtttggggaccttctgggtggttacgggggctgatgccgcgaaggggccccgagctcgccctcccactggcccacggggggcacagggggagacccgtccatacagggctcacccgcgtgtttcggaggctccttgcaccccatcgaacaccccgtctctgcctttcctcgctgttccgaccaatgtgaacaagcaggtcggggcaaaggggaaaaaaaaaaaagaacgaaaaaggaattttaattgaaaccagtggcttaagaggcggcgtccacggggggagcttcctgaccgggaggaggagagcggccgcgatcgccggcctcggacatcgttactagggccatgaggtggggcccatcgaaagtccagctccaccggctaactgactgactaattgaccgacgaggcagagactttggcggcctccgaaaaaaaacgtggcgggtttcttacaggaccaggtgtgcggaaacccggatcgcgagagcgggtttttaatgataaaacctgaaaagtgtttttctctggcgccatacatcactgtcaggcgaggagattcaacttatttttcctttttgaagcggaggctcgcggggaccggaaatatcttaaaatgcaaaaccgcgcggcagacaaagtggcgcggagatgcgggctgacaatgcgagttttcgtcccttttttttttttttttgaggaagattagccctgagctaactgctgccaatcctccttttttttttttgctgaggaagactggcctcgagctaatatccatgcccatctttctctactttgtatgtggcatggcgtgccaagtgttgccatgtctacacctgggatccgaattgaggaaccccgggctgccaagaagtggaacatgtgaacttaaccgctttgccacctggctggcctccaggttttccaagtttcccctgacggtttgcgtgtctgttccacgtgggctgcacgtgcgtttcccttttccgggacatttatcctcgtggcgctgaggtcgcctttccgtcgtgtgtgtgtcggagggcagaggtgtgcaccgcgtggactcacatccccgtgacgtcgtgtgtagacgttgcatggaaacgctgcgtgtacacgggggggggggggggcggacggtttccgtgcgtgaatgtgtgtcggtgtcgacagacgagccgggcgccccacccgggggcctcgaggcctctggtgcccgtgaccgccccgccctgcgtggtgtctccacccgcagacacagcagcatcgatccccccagggtctcattttggggcagtttgggtttttttctcgcccgtccaggaaggtaaaactgtcatttccaatagagatctcgaggggaaatgaccggatccaacgcacgaacccgtgacagacctgggtttgaatcccaaactcccacttattcattccatgactctgcccggtttaattaatttccttaattctcagtttttcgctcggtaggaaaccacctggggtttcgggatatttaaatcagagactgtacggaaagggcgccgcggaaaatttcaaggcacagaaagcattcaatcaatacttgtcattgttattgatttctaggagctttttacatatgaaggcacagccctttatcacgaacatatcttacaaatacttgcctgcttctttcacgccgtttagcagtgtctgtaatttttagacataaagagttgaaacgtgcacgtaggcaaatcggtccattttccccctcgggtttcttatattgtttttattcctggaaagtgcttctccagggacgcactggatcttcacccacgtggttctatttcacgacttaatttttctatttaacattttcacgcacctggaacggattgtggttttggatctggggtcaggccccccccacccccggctcatttccctcccgagtaattagcaaattttcctaaagctctttgttgactaattctttctttctttgttggttttttaaaaataatttattggtcccgtgtgttcgtaaagacctgggtctctttcaaaggcctctgtttcccgtctgtgaattcttatttggattcgacgccgcctcaattatcgtagcttgaaaataaaacgtgtcttaccctttgagtgggtccctctttcatcatcgatttgacattattacaaaaaaaaaaaaaccatttcttagcattcttgcagattggctttctgagaaatccagatgagcttcggatttattttgccaaagttgaaaaaaaaaaatctgttttgatttaataggaaccacattcaatttaaacactaattattaaagaaccgacgtccttgcgatatttcgagtccgtccgcaggaactcggcgtgctgtgcattccgtcgtgctctctgttttttttttttttaaatttttttcctcaataaaatttgctttttcctctgtgtggaccctgcactcatcgggtcgagtctatttgcggatattttgtgtttctgttgcatcgtgcgcgccgtccgtttctctgatattttgtaacgagtcgaggtcacggagcagaaagctggggggggggttcagatcgttattttgtttcaaactcgtgttggatccgattttggttcgatatgagtcgattccatcgtgttcacccccaaagactagttacaacccgctgtatcaatttttgagatatattttttgcggtaacattgtatccatttcaggggcgcatcgtaaacacgtttcaaattttgtgtcgattcggtcgactggttacaatccatcgtacccactttttacggcggcgccatcgacccgtcacgcactgttagttccgggtgggcaacaattattcgatttacagacacggcgtgaagggctcgcccatcgacatgcatcgttactttttccctcttttttccctgtgatgagcacagactgagacaccaccctgggttgggttgggctcactcgggtgtagacccccagccaaggattggggtgcacggagggcttcaccccaggatgtgtgacttggggggtccaaggaggtgtcatgggccgaactgtgtccccaaactcacatattggagtcctgtgaccacaggaccttggaatatgccaggatttgcagatgggtctttaaggaggtgatggaggtcaaatgaggtcatgagggtgatgcactgcgattctgcgaacagagacctcacgccagctggaagcagaagaagcagagggggaccctgtgtctgggggggtgttttccactcacttaattccccgtctcaacttggttgcttacgcacgacagcttgggaaaggaattaagctctcagatggatactttttttttttttttgcagaggaagattggccgcaagctaaaatctgttgccaatctttttggtttttttttcttcttctcccccaaagccccgcagtgcacagctggatattgtttagttgtgggtttctcaacagggcctgatgagcggtgccatgtccacacccaggatccgaaccgaggaatcctgaggacgcaggaagacgggccattagcatgcaggctgttcccggggccgcgaggccgcccccccccacccaggctggctcattttccgtcatcctacaaatcctccgatgggaagttcgggccctgtggcggcagagctgggaataatccgccatctgccgtcctcggacgtgagagattaaaacgacacagaggacgaaggctccccattcagttgctaatgtcggcgacccggcggctccggcggacggaccgggctgtgcgcccagggatggcccggaccaggcgcccggcacacgcactgagcaaaagccactttccgaatgagggacggccgggccggctcagcggtgtccacccgtcagtgggtcggtgggctctgcttctcaaatatggccgatgccacgtgggtgtcaccagggccacagcctccaacagccacagacggcagacgcgggtctcgcaacggggaaaactggggctcagaaacgttaacatcccgccccattcttttcgcaaacgttgtcggaccgactgtgttcattctccccgtcgtccggcaggacatgctgcagggtttccatgcacagaatttggttttacattttcaccattctttgcatggagacatagctgttcttttctttattttttattttttttgctgaggaagattggccctgaatgaacaactgttgccaatcttcttctttttttccccttctttgccccaagcccacaggtgaacagttgtacattctaggtgcaggcccagcaggagagaaaggacaatatttcttcccgctttttgaacaaggaatgtgccttttcccgtctttccctgaaaggaacacagtcgaccttttgttctccctggaaaagccggggtctgacgggcacgtcttcctgctctggttcctgcctccaccaggtgctgacccgactgcgggacctgggacctttctcttcccaaattctgggcttcaggaaggggtcgatccagccgaggaggtcaaagggcgtcccgcttctacaaagggtcggatcctacatattttcactttttcgggtccgggggcctctgtcgcaactgctcgagtctgcccacaaccccagagcgggcacaggcgatatgtaagtgaatgcgtgtggccgagtgccgataaaactttatcgacaaaagcagacaaagggccggattcagcccaagggaacccctgagtgcattatttaggcccagagcgcacacctgcggccgtataagctgcccgctcacctgcacaggtgccgtctcccggggtctcccgccccggaatgtgggggcatcttttgaaacgggggcgacggccaagctcttgtcggccggacccatcccggggtctcagctccttctgaggagactcagaaggcgccccaagcgggtgtcgggggtccccgcagcggaccccggggggcaccgggctgaataagtccccggatggggccctctgggatccgcagtctgaggcgcctgtcacagaaaaaaaaaaaaaaaaacctcattatggaaacggctgtaaacgcccattatctcgcaggctgcaaatccgctttaaaatatgcagacttcaaaataaatttttaaaaaaacccaaaatgctgtgatcattggacgctgcccccacccccccagaccctccggatcgctctcctcgttgccatcttccggggctctttttttttttttttggcaatttcgggaaatccccacggcgccttctgtgcaaccggcagacggcgtgtgaccccgcggtgacccgagggggccgctcctccccagggggcgcctcccgggcctaacgaggggcgtgggccgggcgcgcgagacgggatggaggcggggggtccccgggacgtgcgcatccgaggggtctccgggggggggagagaaggtgggtccccagaccccgggggtcgcgccagccggatggatgtcaccttgcgtggcgctgcgctccctggaggatttttcccccgtcgctctgcgcctttggagggaggaggaatggaaatgagcccgcgtttgaacgacgggcgtccgaggggaccttcctgaaaacaaatagggcctccggtggcctccgccgtctggccttaaactgcccccctggccgggcctttgatgcttttttttttttttgaggaagattggcccttagctaacatctgctgccaatcctccgctttttttttttttttttttttgctgaggaagactggcccttagctaacatccgtgcccatcttcctctactttatatgtgggacgcctgccacggcatggtgtggcaagcggtgccatgtccacacccgggatccaaaccggcgaacccccaagccgccgaagccgagtgtggtcccttaacccctgcgccaccaggccggcctctgaagctgtttcaatgcctcctccgctgtggcctctcgatttccgcagaacgaggcgcagccacgtcgggggagggtggaaaaacatcgcggtggggggaggcgcacagaggacacgtcgcacggagagtgttttttgcccgtttttctctgggccgttccccgcgcgtggagatcgaagttccggtctggaccctccttaggaaaagccgagaagacggagggcttctggcccggcgcggggtggggggtgcggggggcctcggcggaggccgcggaaatctcccccagatttaaataattaatatgacaccttgagctccgagtgggaaaattaaaaaaaataatttaaaaaaaaaaaaaaaaaagcacagaaaagaaaggggacgcccgagttgccgtttgcaacactggccgggccggtggtggcgggggcacgctcgggggtctttgtcatgctaacggagccctttgttggggttggtcgccgccctcgaggcaggcggcccggaggagagcgggggctgcgtcgccgggcgcaggacggtgctttgagcggcgt

SEQ ID NO: 27 - DNA, 2958 bp, Equus caballus
accggattcgtggcccaacccgtgtcgttgataaattgctcgtcccttgtacatgggagaaactcccgcccacccccctaatacccacatctttccttgttcacaaagattcttcggtgaaagatcctgctataaaatccccctaggttgtggattctctttattccccaacccccagcaccggccaggtctcatcgggcgctgttcagggtttaggaagagaggaggaagggaactgacagcttcatttgggggggacttaaaaaatcaatgtaaaagaaaataatacgtcaatattttatttatcagatttatctatttctactgattatgatcatttcctgaattcaggctcagatctgtcaattcaaaacactaccggcgccaaaatcaaatttgtatactggaaattgtttaaaaacagcccagacggggaggattctggccatttggatcctgcctaatttgcagggcacaggaaccgcacctgacagttggcctcaaggttataaaaccccaagctgacccagatactccccattgggctgctgggtgacacccctgagactggcagcccctctgtgatgcggtgctccggggtcgggtgcggtctccccttttgcaggggtcctgctcaccatgaagatagggaggcagtcaggccgcaaaggaggccccccccgagggcgggtgtgtgtgtgatgggggtcacccaagacggagggcgggtgtgtgtgtgatggggagacacacagagacacacagagacacacagcacacacacacagagacacacagagacacacagagacacacagcacacacacacagagacacacagagacacacagcacacacacagagacacagacacacaagacgcaacacccaatacaccgcacacacgaaacatactacatgcatgtactatatgcacgcatcgtacacttgcagacacacacacattcctcccaccaccacccccataacagagtccgttaggatgtatcacttccatgcagttcttggtttttttttttttttgctgaggaagattggccctgagctaacatcggtgcccatcttcctccgttttgtatgtccgtcgactgggtcctggaggagggcggccctgtgcgtgtaaaccagcgtccgctcggccatcggggggccgtcacttttgggggtcagctcctcttccgcagggacggccccacgcagagtcagggcagcaggtggagccggggtggtgctcatcatcttgtgcttagttccccgttcactcgggctcaggggttcccctctgccctcatcctcctggagtgctgagagcttggttgttggacgttggaagggatctgcttcctggccctgtggtcactcagccgctcaatgcacaggcccggacgagcgtaatttagccgctaaattgtgctgaatgtcaggaaaatgggcgctccctttcgcgcgggggctactttgccccttgaaattgctttttcttccaattatagatttttgtggagaaatcgtctgataatccgataatatttgcttctccccgtcctccgagggcgattatgaatgtttaataagacaccaaagtggaagaggcgtcacgagctgccgccccataaattaataatcgggataaattatgcagccgtattgtgtggaaaggaaaaaaaaaaagaaaagaaaaaaatcaatgggccgacttttcaacgtccacccgtctcgtttatattctgggtttcagagttaatgaattaacttacagcccgtatgagaaaaacaaacatgtcagctttttgaattttaatttttagtgcacaaaaaaagaaaaaaaaaaatcggagagttcctccacgctcggatgaaaatggggcgtttgcaaaggaaactcgaaattttaatccgagggagtcggcgattgttccgagagtcaggggtgcccggcgtgcgaggccctgaggagcttcagaaaacgccacaaaagatgcctcccctccgcctcgctcactggagcacgcggggagggaggagcgatccgccatgtgttccacccaccacgttttgccagaactttccatcgagccttttttgggggtgtggtgagggtgggtgacatgccccatccgtcagagccaatcctacctgtccgttgcctttgcccctccgcatctacccagttcccgcgtttggatgtggctgcgatggctggatgagcagcagccactttgcacccttgaggcagcctgtggtgaacctgggtttttcacgggatccagcggaggctgctcgctgtggacctgctgtgtgtgaggacatccaatcctgttcccagaacaccctttggtcggagatgtgttgtttcctttgttcaaaaattctgtttccttcataaaaaggttttgcgttaaaggacagagagacaaggtctggatcagattttataaaatatcaaacttaagacactaaacataaggcgggcacatatcccaaccctgttagtgttttttccagccaactttggagtctttagatatcggcactgagatatttttccaagacaagcgaccgtattggctgcccccggtccgaatcctttcgcgtcctctttctgctccgatgtgtaactgcggcctgatcggcaaaagcaaagaccttccattaacccgctggccgagaatctgggctctggatttctgctgcgcttggggaaaagcgagagggacggcctggaaaaaacggcgcgttgctcatgccttgtggcttctgagccgcccacgctgaattccagcggctgctccaatggcaggtcccccccccccgcgtgctgacactgcggctcccaggaccaacgttccagagagacggggaggacggagcctccagcttcccctcctgccccttcatatgcacaggacgggagacgcctggagacgctcagagttc

SEQ ID NO: 28 - DNA, 1214 bp, Equus caballus
gatgattttatcctttttcagggctgagtagtattccattgtatatatatctcatatcttctttatccggtcataggtgctgcgtgacttgggttgcttccgcgtcttggctgttgtgaataatgctgccgtgaatacgggggtgcataaatctctttaaattattgatttccagttctttgggtaaatacccagtcatgggatggctggatcatacagtatttctatttttaattttttgaggaagctccacctgtttcccgtggtggctgctacactaattatttttttcttcctgacgttgtccgtttgtccgtaatctgggcccttgtcgccccttctccacctctgcttcctccccagaaggcgagctccttatgggcagaaatctgggcctttctgctcagatgagtctaaacgcctagaccttggctcggggtggctgctgattgaatattcgagcctggaggtccccagatgcagcttgaggggctcagacaaaaagctccatctacacaaacaggatacgaaagaaacaccgtcgagatgaccgttagggaggatcagatccacgtgacagttttgaggcggccaatagttgatcgactttctgagcgaaacagagtccccagaaagttgtgcaaaaggtttttttttttgcactattttttttttctgagcagaaagtgaccacggaaaccaaaatggcaaattgccgtatggggacggcccggtggctcagcgggtacacgtgcacattccactttgggggcccggagttccctggttcggatcccgggtgtggacatggacccgcttggcaagccatgctgtggtaggcgtcccacatagaaagtagaggaagatgggcacggatgtttgctcagggccagtcttcctcagccaaaaaaaaaaaaaaaaaaaaaaggaggattagcaggtgatgttagctcagggccaatcttcctcagaacaaaacaaaacaaaattccagtggtgtggagcaagattttattaaaggcgcgcgaggaaggaggagggcggtgggtgggggggacagaaaccaggcctggtcgtccccccgacccctccaccccctgccccgcagtaattaggacatcacggcttctccgccggggaaaaggtgcaaattcgtctcttcttctccaaagacgcatccgggaggggccgcagcccccccccccccgcccgcc

SEQ ID NO: 29 - DNA, 2319 bp, Equus caballus
tgcaacatgggagggaaaccctgttgcaatgatgagactgacaccttgttgcaacgtcatgaaggaaagttgttgccacgatgagctgatctggacacacgttattaagcaaagtccacggtctccatgagcgttcatctcgctgtcggacactttatgggtttagacaaatggataatgccgcatacccaccattattttattgtgtagagtagtttcgctgccctaaaaatcccctttcctccacctatttatccccctctccccgaagcccccagcaaccacgggtcgtttcaccgtctcccaaagtttttatttttatttcttgagaatcattgatttttttttttaatcgtcatgaaatccgcatcccgcgtaattcaccattttaaagcacacagtgtgcattgtgcacgcccacagcggtgcaaccaacacctctgtctggtttcagaacgttctcgtgaccccgagcggtaacgttgggcccacgagcaggccccaccgccctcctccggcccctggcaccgatcatctgcttcagaattgaccgaaaaatggctcgtcagggcggccagaagcgaattctcccagttgagagcctggtctaaatttcagagggattctcatcggtttagtgtcaatcagcaaacacacgtggagcagaaacgtgaccccatctgtttggccgtctctcttcagacttcgaggcaggtgtccgcccggctgtgggtctggcggctccttggggtgttggaggaggtgatgggggaggaaaagagaaaatcatttctgttctggccactttctcccccggagtctccccgtcagcagaatttcttatttcggtggcagttttccaggatgatggagacagcacgacactccctgatggccaggtcctcccgccaaaaaaacacaaaaatcatccacaaaagtccgactgtaaagaatgtcccctggggggatgccgccatctttttttttatatcgagtaatttgccttttttttttttggtgaggaagattagccctgagctaacatctgcggccaattctcctcttttctttgctgaggaagactggccctgggtgtgggaggaaggaaggtgcgtggatggactgaagggtggcctcccaaaaacatacgctgagtcgtgaccccaggacctcagaatgggccttatttggaaatggggtctttgcaggtgtgatgaagggaaggatggagaggagggcttcctggaggaggcggccctgaatcaaggatggagaggagggcttcctggaggaggcggccctgaatcaaggatggagaggagggcttcctggaggaggtggccctgaatcaaggatggagaggagggcttcctggaggaggcggccctgaatccaaggacagcgtcatcatcagagacagaagaggagacgcagacgcagaggagcagccccgtgaggatggaggcagagacgggagggaggcggccaccagcccagggaccctgaagccccggacgctggaagaggcaggagggaccctccccgggagcctccggagggagtgtggccctgtgacccttgacctcagactcctggactctgtcaaggtgtcgaggggaatgagccaaacatcccacaggagcagggtccaatcgatgattcagttcagaaaatgagaagaaggaggtggggagagacagagttttcacgtgtagacaagctggggtgtagacctgcttctggtctcccacatccttgttcttggttgcatagtattccacgaacaaaccacaaagtttctggtctcctgtatccttgttcttggctgcatagtattccacaaacaaatcagaaaatgtagtccagtcctctgtgggtggacacgaagctcctcctgaattttcagcatggccaccggggtgccctcgacaccctcgtcccccagaggtgtggacgtgtgtccctgcagacgagcacctgcagagggaggagcggggaggtggctgcgtcaaacagcaaagtggatttgtcctccggggaaaagctgtgcccgttgacacccaggtccacaccgcggtggaggtcaagttccccgagccctggggccccgcccgtcctcaggctgcaccgtccccgccggtctgagaagcacaaagcggtccctccacttggggacgatggtctaaaaccgtattttcccgactttgagcttctcggtcacggttttcacaaacacgtgtgcttctttttctcaaaactgttctcgccttttgtggcttttttttgacacgatttttttctccccgaaaatgtaggaat

SEQ ID NO: 30 - DNA, 2165 bp, Equus caballus
catctatccacccatccatccatcatccatccatccatccatccatctatccatccatccatccatctatccacccatccatctatccatccatccatccatccatccatccatccatccatccatctatccatccatccatccatccatccatccatccacccatccatctatccatccatctatccatccatccatccatctatccatccatccatccatccatctatccatccatccatcatccatccatccatccatccatctatccatccatctatccatccatccatccatccatccatccatccatccatccatccatccatccatctatccatccatccatccatccatccatccatccatccatccgtctatccatccatccatccatccatccatccatccatccatccctgtatctatccatctataatcttcattgatccaccttccttcccaaccatccatcaacctgtccgtccaccatcttgctctcagtctctctccatttgtctttgtgactctaaacctgggatgaacgtggccgtccccacaggacaaggggcaccacgtggacacattcttggtcgccccacttggaagtgagggaacaggcatctagcgggtgtagaccagcgacacagcagacgccccacgacacacagcgcagccgccccaccgcggagtgatctgaccccgaaggtcagccgttccgaggtggagacaccccgtgtggcctatgggccacttcagcggggccagcggacacgtaaggagcccgttgcgggtctctgtcaggaaaggccgtccgggtggaagggaagagccgctccctgctggtgcgaagggaggaagtccaggggggtcctgccccacagctgacgtgcagtgttggcccctccgaggcggttaatccgggtccccacggccgggccccccggagaccccagacttttcaggtcagctggaaaccagagcaacgggcaagggaacccggaaacactgttgaatgactaactgttgacttcgtgttggtgcgaccttgcatttctggggtcgtctcctcttgggcgcaatgtgctatcctttcactgtagctacattttgggttcaatttgctacatcccgaccgtgttgcgatcctactgtcagggtgaccgagggtcagtcgatggacgtctcctcttctctacgcgcatcgatgtcgcccgcccaatggcctcctccaagtggttcccaagccaatcgagtgtctcgaaccgtggtctcttcttgaccccagactcaccaagccacccgaattcccaacatttcagacgccggagatgttgcacacgacgcaaaccccaaaccggcaacagctcgcccaccccggacacctccctcatgtggtccgccatcttggtaaatgatgtccattctccttttcctttttgtgcttcattttcaacataaaagggagtcccgttggtcccacctccaggactcatggcccccgacgtctctgggccaccatcgcgtccaacggggacgtcctcagtcgcatccccgatggacggtgggctccctacctccaccccggctccccttccatctggcagccagagggaggtggtggaagcaccagccagacctcccgccccacgtcccccatggcgcccctcccgccctggaagaccctttgcaggtgtgaccaatggtcagcacgtcacggctgcacagggcggccactgaccatctcacagttgtgtgtgggggtcagaggtccaagtactaggtggggggctgggctgtgtcctccgctcagggcctcccaaggcccaaatccaggggttgagtggggtgggcctctgatgaagacgcggcttgcaggttcattcaggttgttggctgaattcagctcctcggggttgtgggcccggggtgtggacacggtcccgcctgtcaagccatgctgtggtggacgtcccatgtataaaggagaggaagatgggcacggatgttagctcagggccagtcttcctcaggtcgataaaagagagtggattatagaggaggatgggcagcagatgttagttcagggcgatatcttcctccaataaagaaaagaaaacccaaagtaaagaaagaaagagaaaaagaagttctcacgggggccc

SEQ ID NO: 31 - DNA, 1749 bp, Equus caballus
tttttttttgtggggggggcgagccatcgagagcttatgttgaatgccctccattaaatcattggattttgtaggaaagtgggcggaattgaaaaaaaaaaaaaaaaaccctagtttcttggagggccttggaaccagagcagccgggcctgccccatcggccctttattaatattatagatgtcggatttgtcgacaggatgcgtgtcgtccgttcagaggggcggatgaagagaggccccgtgtaatgataacctattagcctcgaatcggaaacacgggtgttggggtcaatcaataaacagcataggataggaggggcatgcaaatgcagctttctaaatggaaaagggggaggaacgtaaaaaaaaaaaaaaaaaaaaacgcaacaaggaggccgtctaggaaaacgcgttaagacgcctataaaaatccagcccctgtgatcgatcgtcataaatatttaatgggtggggagggtttggttgttgtttaaaaggctctggctcttcgggaaaaaccattaacagcccccccccccccagtccttctgattaatagaaattgtctttggaattacggggcccgggctgaaggggcattcctgaaaagatgccccccccacccccgtttcaagggaacccaggaaacccccgccccggggttggggggagccttgagttgacaggtggtgtagacgaggccggggactccggctcctccgggaggcttgcaggccccagaggctgcaaatggtgcccggcaattaagagctgggggcgtgaaatctgatttcagggaaatgcatttgggacccccgcgaggagactcgttgcgctggggctccaagtggaaattccgagccagtccctttttgagggattaaataaagcaaatattaaatatctgaatattcatcgcttccctttccctcggcgttggagagagagagagagagaggcagaccccttagaggcacaggccgttcattaaaatggccctaatgcacagacagaaagtcagattattttgcaaaatgtaaaaaaaaaatcaatgtgcatttcctcgggccagcctaagtcggtccctggggtccgtctcccaccagcctggcctcagaaaaggccggttggcatgtggggcggccggtggccggtgtccgggctcagctgtgtgcacggcctgtgtctctgggtgtcccgggcacccgggctggcccgcaaggcctgggcgtccgagtcgaacgagggcccggagcgcagacgaccgccgagaagtcttcggtctcgtgtgttttctgcagccggggagacggagagaggacagaagacaccccacggccaccggccccacacgaagagtccttcccgctccaccggccccacacgagagtccttcccgctccaccggccccacacgagagtccttcccgctccaccggccccacacgagagtccttcccgctccaccggccccacacgagagtccttcccgctccaccggccccagccagcaggacgtggccccggggggcggctcctgagcggcgtgtccgagcttcgcggcccggcctgggtccccgggaggccggctgaccggaaggagtccagctggggtaatctcggggtgtggggggggggtgcagcatcttggcctggctggccttgggctctctgtggggtcggcctgggtggtggaattcggggaaggtcaatctgagctggaatgagaggtcccaggttcccgtga

SEQ ID NO: 32 - DNA, 944 bp, Equus caballus
gaacccggaaacactgttgaatgactaactgttgaccgttgaggtgggtgcgaccttgcatttctggggtcgtctcctctttggcgcaatgtgctatcctttcactgtagctacattttgggttcaatttgctacatcccgaccgtgttgcgatcctactgtcagggtgaccgagggtcagtcgatggacgtctcctcttctctacgcgcatcgatgtcgcccgcccaatggcctcctccaagtggttcccaagccaatcgagtgtctcgaaccgtggtctcttcttgaccccagactcaccaagccacccgaattcccaacatttcagacgccggagatgttgcacacgacgcaaactctaaatcggcaacagctcggcccaccccggacacctccctcacgtgggcagccatcttgggaaaatgaaggtccttttcgccttattcctttttgtgcttcttttttctaagtatatatgtttttctttttttttttcctttttttctaagtcaaggcacacaggacgtgtctgtgagacaaatggcgtctaaaagggtttcgtatattatgcctatcgtcacttacggcgcccgcctgcgttgttcttccttctctttttttttattttttttttttttttttgttttttattttttttttcttttttttttttttcttaccccccccgccccccccctttcatagtaaacaaaaatataaaaattttttttttttttttttttttttttttttgtttattcacttcctcccccccccctcaccccccccctcccctctcttttcttttcttttttttcttttttctcttcttttttttttttttttttttttttttttttttttttttttttttttttttttttttttttttttttttttttttcttttctttttttccttttacccccccccccccccccct

SEQ ID NO: 33 - DNA, 2158 bp, Equus caballus
catctctcccctcaccaccacccccgccgccccgggagcagttcatggaagagctgaccgcttttgtatccaaatcttttgaccagaaaaacaaggaaagcggctgcggaggcggcggcggcggcggcggcggcgggggcaagaaggactccattacctacagagaagttttggagagcggactggcgcgctcccgggagctggggagctcggaatccagcctccaggacattacggagggcagcggccactgtccggtgcatttgttcaaggagcacgtggacaacgacaaggagaaactgaaggagttcggcacggggagggccgcggaaggtaagcacttgggggcgcaggcggagggcacccccttcctcccccggggtcggggtctcctcgccccccggaggagtctgcgcgccgcgcgccgcggagagggccccgggcgccgcggctcgctctgcgttcgaccccaaagtcggaaatgccagccgcggctctcggagggagaggccccgggaagccatcgtcaggcttttcgtcagaaagcggggagaagcgaagcgcggagacaaggaaggacggagggaggcgacggagccgaggacgggcgggaggctggggccgcgcgcgccgcccgcgcactcgcttccccggggcgtcggcaccgggagccgaggcgggaactctcccgggtctgggcggatccgggtcgggtggtgtgtgccccaaacccgaggctggctgtggggctgccagcgcccctgagacctcctcccacgcgcgccgaggagagagccacgcgcgtctctccccgcgcccacccgcttccccgcctcgcgatgggccggtggtcgcggaagcgacgcgcgcaggggccttcaacgtccacactggctcttggccgacgccggcctggagattccaaccactcgggtgcccgcgcaggtgtccggggtccggacgtgacagggggtggcgggggtgggagaccccgaggggaagcgagtggctccgagagcgcagccggccgcgccgagcgcgcgtgtcccggcggggcctccttcccgcacccggcgcgcaggtttcgccccgatctggaaaccgaagcgaaaaaagggcagctttgcaaccggtctcccagcaaggcaggggtggtcccaagcggcgaggtaggtggggggtgggggtggcgggccgtgagctgtctgtacaaacagggcgactgacagcaataaatcagaggcatcaaattggctcgatttctcaggggggcacccttggagacgcctgtgatgtctatttttcattacaaagagaaggcaggcaggggccggccgcttctctccgcgggtcccgtctccccgactgtcagcgtggacaggggtcagacggtgtcccccaggacgtgcctttctcccggggagcccacgcgccctgcttttccagacccaacgctcggatggcaagagtttggtctccgcggccttgaaaacgcgcagacgacccacacatccctctgaggtttgaccttgtggaagcagcggaaagctggcagaggattagaaataagcccccgaccccccccccccagcagcagcgcggggggagctccggcctggccggggcctcacctctgggttcgcctcctccctccgccggtcccccgcgcacctgggtgtgtgattcatacaaagacatttcgctttgagcagcgtgcctgtcaagcgagaccggccggtccttgaaggctatgattaattgcaaaggattgcaactcaccgcggggacgaaataaggagtaaggaccgtttgtaaggggctggaacttcactcgacactatcgacaacacgcgagacacccaccgcaaagccgacggcggacagccaacgtggtatatggacgaagtaaggagcccttagagatgcagctaagtagcgaataagcatccatgacgagcttgagagaggagaaaattataagtaagcgtgaggttggtgatgtgtgtgaataacctcactaggagacaagcggaacaaagctcaatgagaaagactgtactaattgcgtcgagaactattgcagctaggagaccatgacatagacatatatctctagataaacaatgtaaagaaaaggcaaagggaaccaagcagaaag

SEQ ID NO: 34 - DNA, 2200 bp, Equus caballus
cgcttacaagacgcctcgagattcctcgatagcgcgggttacggattattccgggcgccacggtgcgctcctccacctccagctgtcaggaatttgcacgacttgctctctccttcgcacgcttcccttcttctccccgtcacccctcctcaggcctcccccctctttcctctttgctccactcctgggagcggggaggcgaggctgggggtggggtggggggtggtcgggcacgctgggcgtcttgatgagcgcggctcctgcccgcccgcgcggggcccggattaacccgggcgggcgcatgaatcggggagaccccatctggcgaaccgccgccgtctgcggggctgggggtgaggggggcgcccccgggtgtgcgcggcacgtgcgtccccctcgggcgggcctttctgcggcgttgggaacgttcagcgcggcgccttcgtttatggacgggggtgggggggagggttgggggctccccactcgctttctcggggtgggggggggtccccgcagaccccgcctgggaggtcgggcctgcaagccggggccttcccgtgtcctcggttctcaggcttctgagccggggcagcggggccgtgcagactaagtaggagcgctcagtctctccgggggctgctttgcaataaaccgaattaatatcgcccaccggggagggggccttgaaaagcggaggttttttttttttttttttttgaagaagcggttccttcttggtcgtagggcccccgcgcattttgcaacacaaccgtcctcgggttttctggatgagacgaaaacgcagatgtgtcttagaaacgtttttaatttgcaaaaaaagaaaaaaaaattgtcttatcttggttcggtgtctcttcaggcgaaagggtcttgtccgaaaaaaacggcaggcgttttctagaagcttcctgccaaagaagggagggggggaccaggctgggggggcccctgtgtccccggggcgagtccgttggggccgcagcgagggtgggtttcccaccggccacccttctctgcaaagatggatgaggtggcgccgtagaaattaatgaaaagatgaaactttcgccgctgaaggggacatccactctgatgtcatctcgccacgtctttctgccggggatctgtaatatctccccggccttgatgtactgtttctataaaaataaattacttgtaatttaattccacactatttctttcaagtactctattaccgaatagcgcctgagcggcggcgggaggcagcgggttgggcaggagccggggccttgagtgtcagtccagtttgcggggagggggccctgaaaataaaaaaaaaaaaaaaaaaaaggaatggtgatcgatccggggggggggagcgaattaaaatttaacggctgtaaataataatgcaaataaatttgaggagaggagaccagaattttttttttttttttttttttgcaccggccacagggccaaaagggcagaaggcgctcataaaaatcaattagtgctaacacggccccgcggtcgcgcgggtgtcaccggggcggatggcaggaatcaaaaggccacgacgatccggatttgaatcccgactcctccgaattgttgggggctcatccatcgcggggggtggggaggcgggtggggacagctcccccgtccccgcggtcgttggaggatcgggtttcaatttggagtggaaatttgctgtaaataaattgcggacccgatggaagctggtcctgattaaccttttatttttagcatcgtcctggaagctcccagcgcccagctgtcagggtcctaatcgaaagttatgagaccgcggtgctgcggagcggggtggggtggggggggggcccgtaatttaattacaacaaatatctctgggttgatggcgcagggagctaaattaaatgtcattattcactgtctgtaatggaaatcagaaggaaatcagattagggcgtttgtgaaagaaatcggtgagtgccgcttaatgaagaaatgactgtcgaaaccagtgtcgcgagctttagttagcatattccagtctaattggaattgaccgcgaatcaccccgaaagcctgatttacgaccgcttaacgcgccggctaattcatcacttttattcttcataatgttgtgttttttttttttttctttttcctccccttccgcgac

SEQ ID NO: 35 - DNA, 1399 bp, Equus caballus
acggaaggaaggtttgcgcgtttcagcttggagggggcggcgggggtggtgtgggcggacttttctttctttttttttttttttggaatgacttttcaaggcaaaaaagggagccaacttttccaggctccctctgcctggcgggatgagcttttcgaacgttctggaaggctcagctctcgcgggttgaaaaatgcctctggagagtctgggaaggacggaaaagttgacgtttcttggggtcccccccccccgccccatccccggggggttttgctgaggtttctctgcgcggggtggggggtcccgggcgccccccagggtctgcgcttggagcggcggcgccctgagcacacccgccctgaactcccgcacggaggccgaggccaggctgtcccgggggcggtggctccgcgtgggccagtgacggccgtggcggctatagggccacggacccgggtaggatagacgcctgcaataccagttaggggaaattaagtgaccaagaacacggagggaggaaagccccagatgtgggccagccctggctgcctggaggcggtgtgaacgtgggaagtttttggggggagggccacttttgcatcccaatcttggcgtccggcctgtgaagctagctgggcggggccacgatcccggcgcccttggtcgcccaacctctgcctagggcgcccccaaattggacgtccttggagaggccaagggcccagagcgcaaagccggaattattggggtgcgtgcaccccgttttcatggatggcgcacgactctgtcctattaaccgggcccctccaggcttcctagggggcacggaaaacgcagacgtttgtggcttcggggcgcccccagcttgatcggggaggcgcctgccttcggggagctctttatctcccctcaccctgtgcgcgccccccactcctcgtcgtcgtcggcgaaagtgcaaaaatgtgggaggtcgggaggggggccatgcccacacaaggagatggaaagtccgccagcacctcattcttcactctggatttatatatccaggggccctgccggggccgagaagtgagtgacaggtcccacctcctggtagccagttacgcgcagggctggggtgcggggtgcggggtggggggccctgggggaggggaagaaaacggaagaggggggctgggggggtgtgctctgcggggccggggtccctctcgtggccacaccccaggcgccagggaattggggggggcccccccccgccgtccagctcactggggtgtgtctgtctgtctgtcccgtccgcaggtttgggttccagaaccggagggccaattgctgaaagcaagaaatcagatgcataaagtggttgcgcggggttgcgaaggtgggagtgggg

SEQ ID NO: 36 - DNA, 1618 bp, Equus caballus
gaaggaggccgcggttttacaagggcgcatttatagacccgctggcacgtattaaattcacgctgtaaaaactcgcagtcccctttggggagggcccggacagaaacccaagcacggttttgcaaattcagagggaaaaacagcccacacgccccgggaaccacccacccgctcgccgcctggagcctggggttggggggatggggtggggggggagaaggggaggctggcacgtgtctacactgcccctgcggaccccagggttgcgggtgtctgcgcccctccaggacccgggccgaccccgcgcctccgagttgggggtctctggtccagctccgagcagagtcaagagggcccagcgcgcggggtgcgctgcgtggacgtggggcggccagcgagtcaggacacagcatcgaggtccccaaagggacccgcgtggggtgcatggggggaccctgcgaggctggaggccccggcttcgcagccccccgtggcgggtgggagcgctctgggcagagcggaggcgtggccaccacgcagtgtagacccgggtttctatctggacctctgtttgctgaagggcgcgacgtccgctcggtggggccccggcctcgcgggtcagctgggccgtggggagtggggagcaccaagagacacctgggggggggtcagctggggttccatccgggtgctctcagactccccagcccaaggcgggaagggcgtcagggggtctgcaccccaccctcgattcgacccccgcccccttggcctgggcgcatctcctgcccgttgacccactttccccagggcggggcggcccctccgcatcgcaggcactgcggcctccaagagggagagggtgagccatccggccccaggacattagcccgacggaggactgggggcgtccgggtccctgggagggggcgtgtgtggggggggggcaccggagccaaagtggggaccctgagtcggagacgcgtcaaagggtcagaggacccggcgctttggggaggacggggggtgagctgtagacaccccgatattcgcgaggtcaagggggtgggcgcggctcccccagtctggctctgtccgctgtctggccagcgggaggaggacgatggggtggggtgtccccggaggagggtccgtccgcccccccaccccgcacctaggcgtcctccccgtcctcaccgcgccgcgtctgttccccacgcaggtccaggcgcagctgcagctggaaggcgtggcgcacgcgcacccgcacctgcacccgcacctggcggcgcacgcgccttacctgatgttcccgccgcccccccttcgggctgcccatcgcgtcgctggccgagtccgcgtccgccgccgccgtggtggccgtcgccgccaagaagcaacagcgagaactccagtaatcgccgacctgcggctcaaggtgcgcaagccccgccgaggccctggggatcttgacccgcccggcggccctgggcccgttggcccacgcagcgaacttggtcctgtacttaaacccggccgcgttccctcacacctcccgaaagggttggatagaccgccccgtgcgggcctgggagaagggggcctcccggggacccga

SEQ ID NO: 37 - DNA, 27363 bp, Equus caballus
tattattgttttgcaaaatgcaaaaaaaaaaaaaattgctccccctccccaccccgccggccccaaaggcagcaataacgaaacgcctctgaggacctcgccgaggtgggggtgcgggtggtgccggggaagctcccacgtgggacccgtctgggggggggggatacctgacttctgcgcatgcgcacggtctgcgccaaggcagcaccgccttgctcgattttccggtctttgatgccccccccccccaagttgagctttttttttttttttaattgctgttttgcagacgcaaaggacatacctagagacacaggggcgcgcgcgggggggggtcggcaggtaaagactgaggcagcgtgaagtttagtgaaatgcaatgaaattcagtcaagtgcaatactgtatatattatagatttaagaaaaacaagcaaaaaaaaacgcaaacaaacgttagcactctggatccctcggcttcggacttctaagggcattaattcgtcttgcatgctgcggggcctggccggctggggcccctcgccgagaggactcgggggtgcagagggcgctgcagggggcggaggtgaggcgcgtggcaggtgacggtgggacccggatgtgcgttttccgataacgttgtgctgtgtccgtaggtggttgcaactttcttcctttttttttttttttttttttccccttccctgtgggctcctccattggtctccactgtcttggccgctggcgtggagcggaaatgacgtcaccaaaacgttgggcgttcccacatggcgcacctgagtttttggggagcgcttgagtttttggggggggatgtgtttggcgtgtcctgggtgcaaaggggtgcccggcttgtccacctggaagagaggcctgcgtttgtgactcagtctccccggggcctccccaaacggaagccgtccgtcttctcctccatccttctgtccgttcctaactggccattgcaccggcctttgctcaaattcactctctttgcaaaagaggttttgatcttttagggccattttttccaccccgttattcctgattttgctccatttctccacaaaaatgattttgcgtccatgtcagggaacgcccaccgtttgccgtttccccaagcagaaacctggctccattcggacacgtcttatatttggtcacccagaaacccttgatcggaatccaaagccccaccctaaccccgtcttccactttttttctttggaattttgaaattttaggaaggctccgaaaggaggcagagggatggagaaagcaagtcagtatttttaaatcccttgcagctttttctattttttttttcctccccccccccgccaccccggacgttaatggcattatagactcggcctcctatgtgaagagtggcttttaaacagccgtgaataaaaaaaaagaagctcctatgtataagccgcaactttgttttcaaggccgaacaaacaaacaaatgcatttcgaagcgtttagaaccggctgcgttcaccctgaaattgaaccctcggcccaagtgggaggtaaaacgtgtgcacccctattttttttttttcttgaaaagggtgataatcatttttgtctacacctaggcctctgttgccggcctctgcccccccccccccccccgaaaaagggtccacggcaacgggaaaggcattgagtctgggccagtttgcaaagacagccggccgggctgggacgcgggtttgggcggttgggaggcctgcaggacgggggaccccctcaccttgattttgttgcatttctcgtggaagttgaggcaggtgtcaccgtcaccccagatgggaacagaacgaacccagcgggttgtgtgagcggcacgggctgtgtagacgggctggcccaggggaactctctgcagggcgtggagcaaggagagcacctccgggccccccgttttgcgccaggaattgtgggatgggtgcaaatgaggacggtggccccacttggggtcggctctcagcatccgggctctttgctccgaggccttgtaggcccttaggacggtggttagacggaggatgctccgaatggcttgtgtgtggggcttggggtcgcggggtcgactctggggtcagggcaccccccctccgtcctcttggcctgcacggcccgcgtgggggtggcacgttgtcagaaattaaacgcacggggtggacgttttctggctgtggtgggtgcatccggctccaaacacgatcctttccacggccgcccgtgtggcctgcacgtaccgttcgcgcggccgagggagacggaccgagtcggaagcaaacgggcctggatctcgtcctaacggcctcggacgcaccaggctctgtggccgcgaatcccacacgcgagttgcgggtttcttccacatccgtttttttcctccttctgccgggaaacggtccccaaacgtctcgggggtgccgggtgttacgatggggtcgatgccgttagattcagggacggtgtgcgttgctcggccacgcagaacggccaacgtttggaagatggcgccttctggggggaccagagaggccctcgatggtcggttttgccaagaccccgggcctgtgggtttctttgctcggaccgaaccaaaggggcgggccggactcgcttcctgcgtgattgacaggaacaccaacgccgagcgttccgggagttttccaaacggcaaagagcatccggtccccggagcctgagttccagccgtgggctcgtttcgggcctcggccacgaggatctggggtctgtacgtcatgggggacacggagacgtttaaatccgacgctggacgtttggagtctgagcttacggccacccccccggttaagatggaaggaaaacgcagggcttgtctgctccgacccttggctttccttctgagcttttcatgtttcccaaagttcaagaccaccccctcccaacgcccggcgtttccacttggcgtctccacaggggcaccgaggaccccgttggggctaattgcgaggatgaaaaattttcaaggcactttgctccatcttcccctaacttggggaggtcggagccgcgaagggattttttttcggttggcaagttcaacgtttcacaaaaaaaaagaaaaaaaaaaaaaaagaaactggtgcctaatttatttaaaaaaaaaaaaaaaaaagaaaactagcttaggaagacgccccccgtttcgatccacgcgaacgcttgatgcaatttctcaatgtcctatggaaatctgctatttcacgagaagccagtcgaggaatgtagacgaagacctgagtttcgaggccgccgcggaggggtggggggggaccccgctatttctggggaggggatggttgcatggacgcggacaccccccccccgtcgtcctccggtggagacgctgaccgtttctgcttctcggtggcgggtggatgtggatgtgttatttattttcctttgggttgaaagttcgtaaatatgtgctattttaattatgtggagtgtaaatttgacatcgctcggcatttatttttatattttttggaggctggtgctttcttttttttttttttttttcttttccctctccctccttttcctccccaaacccacccccccctcactccatcaccccaagatttacgagcagccggcgagatttacgacacggcgacgggggtttgggttctgcatacaaggtgtgtctggaccgacaggcctttatttcagggatctgcacacatgaaaagaaagctcataatttaccccaaacccgcggccacccccccccgcgcccgtctgccgtcgtgcgccccccgcagcaccaaacgcaccccctcttttttccccacccccggtgaggcctcctcataaagtgtattttgtcaaaccgtatggtatgaatgtacatcttgtaaaacggagatataaataaacttataaatatttgtatgcaagtgttaaaaaaaaaaattacctcctgcccccccggatctccccgcatctcaccgaggagaccgactggaaggagctggagggccgtgtgcacacggcgaggggcctgcggggccgccctgtggggtctgggggggtctccctcgtggcccccggaccggccccctgatgaatgtgcatctcgggccacgttctcctggaatttggggcaaagaggaaaaaaaaaaaaaggccccgttttgccctcggtcagcgtttgggggggaaagctgggttttcaatgttcatttctgttttttcggttttttgttttttttttttggttggacggtgtgtggaggatccacggcggggtggccgtgacggtggatccgtttggaaaacaaagaaaaaaaaaaaaaaaggaataaatggaaaaaaaaaaatatcgagtttgaaaacggagaacgtttctttggcctggggtcgtgatcttcctccgggagggaaaggtaacgagccgagggggctgctctgacggcttcccgggttagacacaaaccacatgtgccgggcccggctggtggtgcagcggttaagtgctcaccttccgcttgggtggcctggggttctggggttcggatcccgggtgtagacatggcaccacttggcaagccatgctgtggcaggcatcccacgtataaaggagcggaagatgggtatggatgttagctcagggccagtcttcctcagccaaaaaaaaaaaaaagaggaggattggcagcagatgttagctcaggcctaatcttcctcaaaaaaaaaaaaaaagaaaaaagaaaccagatttgccaagggcacaataaggggaccagggtcgttgatgaaaggtcatgcccttcaaggcctgacttacctctggcgtctcaggccctgggcttccggagagctctgtctttttggggctaatgcaggccagtttgggactcccttggtggcctccgggaaagtgtagccggttgcagttgctccacggttacagtaaccgcgagtgtgggccggtctgttccgattatgcaacattgtttcaaagatctggaaacggccgcggactttgttgccaattgtaactcatccgtttgcaaaaaaaacagcagggccgccggctgctctcaaaggtgctcaggggcccggcccggtggcccagcggttaagggcaaacattccactttcacagccgggggttcgctggttcggatcccggttgcggacatggcaccccttgtcaagccatgctgtggtaggcgtcccacattaaagtagaggcagatgggcatggatgttagctcagggccagtcttcctcagccaaaaaaaaaaaaaagaggattggcagcagttaactcagggccagtcttcctcagcaaaaaaaaaaaaaaaaaaaaaatgagaggattggcagcagttagctcagggccagtcttcctcagcaaaaaaaaaaaaaaagaggaagattggcagaaaatgttagctcggggccaatcttcctcaaaaaaacaaaaacttgttcaggtttctcagccctgaatttctttctgatttttccgtggttcgtgctgccgactttccttggaccacaacgcacgtgtttttttcttttttcttctttttttttatgattgtaacttgcacgtatttgggaaaaacggggccgtgagtttccagagaaccgttttgtggagaattagcttaagattctaagatgttctcactgcatctacttccgggagggtttgggggtccaatcgagttgtttttgcagacacttggggcaaaacaggacacgataaaaacacgcttgggaaaggcggctcctggaccagctcgtgtagcaacaggtcttttttcctttgaggtctcagggttgttgagcgactaacagaccgtaggaagctgggttaggtgcccacctctgttcttcccacgaaatgaaaacgctgacgattaaacccgtcagcaaggacgtgtttgcaggatttcactaaaatgcgccccaaaaagatgtgccgggagcggggacccgggacggtcagtcagacgtcagaaagtcactcaaatacagggcaggtgtgtttcatggggccgcgacctgaggacgcatgtgtgcatgtgacattgtgtttcctccacggaccgacctcgcccagcgcctggaaagttccggctcccacagggcgtctcccgggcggggatccgacccgaaccccaaaccgtgcaggtggaggccccacgcggacgtcacgatgttctgatcaaggaaaaacgggacgaagccaacggatgccctcacggcgactacagccttcaatatttttggttagatattactttgttaggtgctgccggatccgtcccgaggtcgggtcccggaaagccgtctgcagagaggattttgcacagctggtgttgacacaagggtcgggtctgtccgggcgtttaaaccccatctgtcctcaggcgtcaccgccccgtcgtcgctttacggggggatcctgtttctggccgtggaaacgcggcagctgttttctgggttattcgagaattcggtgctaatgggcgctaataacctgattaattctgctctcgggcagaaaggcctggattttctctgaaaaaccagacccgcgagcagttgttcccaaatcctctcatttttctttgtttcccgtcaaccacaaaccggctttgtgtctcaatagggttccctgtttaatatatttaatatttaatatcaacggaatcacgcataacgaggcctcttgtatccggctggggtcactgagcgtcgtgttttcaaggttcctccgtatcctggaacgtggatcagtacttcatacctttttcagggctgagtaatattccaccgtgtggacggaccacattctgttctcccgttcctccgttcctggacttctgggtggtcttcccttttttcacctcttaggaataacggttctaaggaccaattttggtgtgcggatggatgttttcgggtctctggggtagacacccaggactggcattgcggtgtcacgggctaactccacattgaaaaatggctgaactttttccaaatggagtcacaagtctacactcccacaagcaagacgtggggctttcaagttctcgacatctttagcaacacctgtcatagcctaagattttattatggccgtcctgtgggggtgacgcggggtctcacgggggttgagtacatatcactattggatgatgatgctgagcgtgttttcatttgctcgtgggcaaccagcacgtcctctatgccatttttcctctcaatctttaagtgcgttatccgcctttttattgttgaattcttacagttctttacatattacggatacaaggccggattagatatgggatttgcaaatatcctttcccactctgtgggttgccctttctctttcttgttcgtgtcctttgaagcgtgaaattttttggtttgggtgacatccaaactgatccctttttttctctgattctttatgtttttggtgtcagagccaaaaaagcatcatctaacgggagctcgtgaagatgcaaacttgtgttttcctctcagagttttactccctacattttggtccttgacccactttgagttcacatttgtctgtccccggaggtggaggtccgacctcattcttgctcacgtggatggacggccagcccagcaccccgacttgtccggcactttgtcaaaaaccgattaaaaggcctggtttaggtttggactctcggttctctcgcattgaaccctctgtggactggccgagcgtctctgtggtggctggaagggaccccattggcggactcggcacccatgtgcaggtggcaggcaccagtcatgtgttttgaaaggtgggccgtccctaagcaggcgacgtgttgtccatcggggcgatggggggcctgtgaggcaccgcaggaaggcctggccgggatggagtcatgctggacctgctgcaggtcctcacggggtgggaaggagagagggtcaaaggtcagggccacggaacgggggacccggacccttcaccgccttggggtgatgccacggcagccggtgacaagaggctgggccgtttccctcgcttttctcatcatctcgtccgaggggcttagtcagcaccccccagggtgcctgggcctggggctcccccccgggaacccatctgcctcctgcggggccgctgggcaaaccgactgaggaaggaacgagccagctgagatgccccagggttccagtgggaagggcaatctgctttactcagtccttcaactgattagacgaggcccatccgcactagggagggcagtctgctttgcttgagccttcaactgactagacgaggcccacccacagtgggaagggcaatctgctttactcaggcctttaattgattagatgaagcccacccaccccaaggagggcaatctgctatcctcaggccttcaactgataagacaagacccacccacaaaggagagggcaatctgctttgctcaggcctttcaactgattagatgaggcccacccacagtggaaagcacaatctgctttactcatgccctcaactgattagaagaggcccacccatgccagggagagcaatctgctccactcagtctgctgattcacatgccaatctcactcggaaacaccttcagacattttccaggtctctggggtgggcgagctgtcagggaggacagtgcgggaggctgtctgggaggccagcaggagcaaaccggggtcccctcgtgggtacaagggacgtgacggaccgtgaaaggcaacccaggaggcagcagacaccatggggggaagaagggagtgacgtcggtgacaaaggaggacagaattttttcttttttcatcagaaatgagttgtttgtcctggatccaatattcaatttcatgtttccaggaaccaaccgcctcgaggacgcaagctgtgtgcctggaattctgggagccagcccgtctgtctctctaacaggaccccaaagagagggccggccggttttagggggtcctcactctggtctgagagtgtgtcccccctgaaatccgtatgctggatcctgacccccagtgggatggtgttagggggtggggcttttgggggtgatggggtcatgagggtggagcccccctggatgggggtgatgtctggaaacagccgtttcaggaagtggctgaggttgcacagggtccaccacgtctagccaagtgatggatgtatttcccttttcaccctggctgccaggaaactcagagacaaagccgcccattggaagggatgatgccccacggggccgtccccaggcaacgcccggctttcagacggcacgtctggcctaggactccggccacagatccgggcagcgtggggaattggatgtggagccacctgaggcctcagccagtgtgatggcagccactttggggccagcgtcaggccggacgctgaccctccaggggtcaggaagggcctccctgtgcagacggttgatgctcgagagggaggtggagggtggctgaggtcaaagggagaaagtgcaagggtcaccctggggatgagggccccccaggggagccaggacgaggatttgggggcacacatggtggggggctcgggggcgggcctgcggccctgggctgaccttgctggggtggacaccgagtcccggggttgctggtcccgcctgaccctccggcctcctgaccccggagcgacctcctcgcatcaggaccagaatgcactgcgcgcaggaacggtacccagcagccctgctccgacttcatcacctgtggccgcagaagatgctgggagaggaggcagtcggccagcctggggtcgccccggccacgacatcccccctccggggtccccccgtcacccctgcaccccgggggtccatcgcgcgtcaccctggggcgtccttttcaccccaattccacaaggtccaccgggtgatctccgacctgtgatgaagatattcccagcatgcaccaggagaggatgcttggagcccagtcccgacaccccccccccggggctgtgtgtccctggggtcatcggggtcacggtggccccgtggatgtccccccaggtggccggcacggatgccccctgggggcccccccccagagcaccccgaaagccgatgggtcccccgggagccgggctcagcctccccatggggagcaggacgggggcggtatggacgctgcgtgtttggggtccgggcgtttgcagactgactgcgggggcgtcgttgtcccggctaacgggtcggcgtttgccagcgctcagcgtctcccatggcgggttctgggcgggaggtgtagacccggcggatcgattcgcgcactcgcctcgagggtccggttgcggcggggagagcggacgagtctccaccgcgcgcccggaacacgaaaaccccgcagccggggcggctgggaccctacacgtttatttctcggggtccggggtctggacgcccaggatcaaggtgccgcagatttggggccggcgaggcccgatcctggttcccgggcggatgggtgtccgtgtgccgggtccgcgcggtggaggcgatgggggcctcgggggtcagagtctcactttccagccaagaaacgctgagcgtttcccatgtggtccggcgcattgtggggccgtttggaaacgggggcatctccagcggggcgtttggggggtctttgcgtgtcaggaatgtttctggggtcacggggtggaggggcggagatgcacccggggccagaggcccagacgcgcgggttgggaacccgacggagcccgggatgctgctgcatagaccgcagagcagcgtcgggatccgacgcgggccggtggtgatgctggcgcgtttggggtcaacggtttgacgtcttaggacaaagtcgcctggcatcgtggagtcagtcgtctcattgggagccacaagggcccacgggggaagcggctttggcgatcgagtcacaaagcggatctggcagacccaacgctgagagacccttgggcattttgtaagttttttttgtttttgcttgaggaagactagccctgagctaacatctgctgcccatcctcctctttctttctttctttttttttttttttttgctgaggaagactggccctgagctaacatctgctgcccatcctcctcttttttttttttttttttttttgctgaggaagactggccctgagctaatgtctgttgccaatcctcctcttcttgccccagggtggggacagggcggacggacagtggactgaagggcatttccccacagcaatccaaaagccacagagggttcaggggccatttgggacagtgatgaccctaatggaggagaggagactgtcaaggaccgagttggaggacaaggaagcgaatcacagagaaagggctacaaagaggaggccaacccggtggctcagtggttaagttcgtgtgttccactccagtggcctgggattcatgggttcggatcccgggtgaggacacggccccactcagcaagccatgcagtggtaggcgtcccacatataaagtagaggaagatggggcatggatgtgagctcagggccagtcttcctcagcaaaaaaaaaaaaaaaaaaggaaaattggcaacaaatgttagctcagtgacaatctccatcaagaaaataaaagaggaagattggcacagatgttagctcagggccactcttcctcaccaaaaaaaaaaattacaaagagtgcttacaaacatacgcacggacctgagaccttgagagaaatggccaggtcatcacgggagccagagagacgtgagcaatagccctgcatctttccctctttaagtataaaaagaggaaggttgtggcagatgttagctcagggccaatcttcctcaaaagcaaacaaacaaaaaaaatggcgtctggaacatagttcttttttatttttttttattctattttatttgaaggaaggggagctggcaggtggaccccggtgagtgacgactaagatgtccccctaaatatctatgtgtgggccccacatgcccggccctgagctgcgtgtgcagatccatccccacgcgctcctggggaccccgcaggaataaaagtcgcctctgggacctactacttgggtcccgatcgtgtcgtcccctggaagggcgccgacacgcgtgagactctgtggactgaaggggaggaattggggatggatgagggcaggagggtggagccatcatgatgggctcagtgtccttaggacaagtgacaccggagccccgtttgtcaccccacctgaggtcacggtgagaaaacctatgaagaagatgggcagacgggatgggcgtcaggtccggtgtgctcaaggggatgcatttgggttgacgccgaaggagggacggaccgccagatctggagtaacggacagcgttccaaggagaagcatgtgcaaaggccctggggcaggaaggagcctgaggagggccagcaaggcataggggccgccggaggtcaagggtcagagggcgtgtgtgggcagcgggggctcatcctaagggacgttgaggggctgctttgggggcgcgtcctgctttcctcctccttcttctttccagcgggtgcaaaccccccacatcccacaaaccggcagggaaaaaagtcccggccgggatccgcttgtggggttttgcacacggcacagccggcttccgggtggggtcaccacccgcagcagcatcagtggggaccaaaaaaaaaaaaaaaatttgcagcatttgatccgagagagccgttctgggtgcgcggcgtccacacccgcagagaggcggccgcgtcctcacggtcccatttattcaattaagcagccggccgtgcctgcgggaagaaaggctcattttttatgtcgtttacacagcgcggggtccccggggaccacttactctggggggcggggtcataactgcaccaggcagcgggtgtgaacggggccgatggagcgtctgcagccgactcagattaatggattgataaggggatgtacacggggggccggcaccaggggcggggaggggggactccgcgaatccgggggctgaatcgagccgtttcccgcagctccttccgccctttgcttttgcaaacggggcgcaggctttggggggcccccccggggaccccagttataattcggtgtctgtgggtttcaaagccacgttgtgcaatgtgggcctggttccagaacattctcctcgcccccaaggagacccctctgtttcccgttaggactcagtccccgtatccgctttgtgtctgtggatttgcgggttctggacatttccgatcaatgggatcgatctgggatcaatgggggcaatggggtcccgcactctgtggggtttcgggtcgggttctgtccccgagcatcgtgtgttcagggtgcagccccgttgcacctgactcagggctcctctcttgttcatggctgcatagtattccactggcacgcacaccccggacccacgtcccccctgtggctccccgcgtttctctgggggtccccacagctccccacgatgcgggcaggtccctcccacttcgggcgggttggggccaagctcagacttgagtgcccggatgcaggcccccccacccccaaaggtcctgtggcctctgtctgcaaacatggggcttcgcggggtggaggggggctgcgcccacccagctgatttcgcacaacagagccccccatcctgacccctgactctgtaggacgaaggggctcggcgtgacccccggggggacccctcctgcgtcctcgcgctcagaggaacatgcgtctgtgcatccggggcccccgcaccccgatcctaaaggggcggagaacaaaacggggctgaaagggagcgaattgcagcggacgtgcgtccctggcgcctcggggtcagattcttgtattttggggggactttggggccttttgcatgaaaaggacgccagtggctccacggggccttttctgatattcaatcaatcaatgaaggcggtcggggcggccaggacggagaaacacgcttgaggatggatgattgacaggcgctcccaggatggatgattgacaggcccgccaggatgcatgattgacaggcgctctgggatggatgattgacaggtgctccaggatacatgattgacaggcgctccaggatgcatgattgacaggtgctgcaggatggatgattgacaggtgctctgggatggatgattggcaggcgctccaggatgggcgattgacaggccctccaggatgcatgattgacctttcctataaaccccactggtggccaaaaccggagaccacagggggtgcgtccacaccaccggccccagggacccggctctcagtgtcccctcttgtccgtgacctcacagaccccacagctggggggtctccattggttgccgcctccgccaagatgccctctggggttgccaggcatgttctcggggtcccgggtgtaggagatgctgggggacgcccagtggatggcggctgcctgctcctctgaggtcatgaccccccagaacccacgagggcccctccccagggccaccacgtcatgagggtggacccaccatcgggggtgggggtctgcagggtccatgtcggctggtctcccccacactggaaatttgtggcagtggccccaggacgtttgcacgggtgcattatggggtctgttttctgacatctgctgacggccatggggtgacatcagtcatgggaggccagcctccaggatttgagtccaccggtggtttgagccgcctacactgtggggtcagttatggggccctgactcggtggtaccaaatgatccaggagaagttggcaaaacaccggggggctttcgatccgtacgttttttttccacgatgactctttgcagccggcgctgggcgacctcttggtgacatgatgccgatgcaccggccgtctggcttaaatcccacgactggcacaaacgtccacggaggcagggtcacccgtgggtccctggtcccagcacctcagccgccgacaacacgcttcctgcgacgtttaaaacggttaacgtctcaaacgcacagtaacacaggactctcaggtttaagtcatttaaaaaaaaaaaaatgagttcttgctgaaccagaaaaaacggattaatttgttgaagggaaataagcagatgctgttttatatggagaatccaacccacatacacgctgatccggtgttgacatggggcagtccttgaaccacagcccccggggctatgtggccccccccagttgttcttttcaataaagttttattggcacaggcccattgtggacacacagcccccagcttgttgttttcaataaagttttattggcacaggcccattgaggacacgcagcccctggcttgttctttacaataaagttttattggcacaggcccattgtggacacacagcccccggcttcttgttttcaataaagttttattggcacaggcccattgaggacacgcagcccctggcttgttcttttcaataaagttttattggcacaagcatgttgtggacacacagcccccggctcgttcttttcaataaagttttattggcacaggtccattgtggacacacggcccccagcttgttcttttcaataaagttttattggcacaagcatgttgtggacacacggcccgtggctggtttctgactccctggggccactggctgtcctgcaattttccgcttcgggtttattggaaatagcggctactgttttgagcaggaatcactcgctatttgatcgactttttttccctccaagttctttaaaaatcgtggtaaaatacgtctaaagggaatgttgcccttttggccatttttcaggtcacggtccagggtcaggaggtcatgctgtgtggcccatccatcacgtgcagttttgatctctaaggctttggaagcaacctgaacagaaacccgatatgcgctcaacagtctctctgcaccgcccgccctccagaccctggaaaccatgaatcccctttctgcgtgtggattggcctgttctggacctttcctattaataggatcgcatgctgtgtgtccctctgtgtctggcttctgtctctgagcattgcgggttcaaggtccatccacgtgtatctgtgtctgcacttcgctcctgttcatggctgcgtaatattccactgcatacatgttgtccacaccgtgttccatccccaccaggtcccattgtcccgacactgggcattccccattttttaaatcgcagccctccccgtgggcaggaccgacttctcccccgtggtttcgatctgcaaaccctcaatgccagatcacgcggaccatcttatcgtgggcgtctccgccatttagacgccgtttttggagagacgtctgttgagatcctgggcccgtttgtaaacggggttatttgtcacgtcacgggtgtgctgtgcagttgctcacatactctgggctctaagccgttgtcatatgtacgacctgtagtgttttttttttcccaggacactgtctctcagggccaccagtcattatgattatttattattatgattcgaagactttcaagggcttcctggtgtttctcagaccccaacaggcccagcccgtttccctattattgtttcagcccatcaatttttttttttttttttgctgaggaagactggccctgagctaacatctgtcaccaatcctcctcttttttttttttttttttgctgaggaagactggctctgagctcacatctgtgcccatcttcctctactttatatgtgggacgcctgccacagcatggcttgacacaaggtgctttgtccacacctgggatctgaactagtgaacactgggccgcgaagtggaatgtgagaacttaaccactgagccaccgggccggcccagcctattgatttttaatgtcggtccctctcgtcctggaaaaccgtaggcaatgaggccacgacgcccgcaagcacaagttctcaagcctcccgcatcgacttggtcccttcccaatttttccctgattgtgtcccttctgggatagaaaatacgccgttttcctcgttttggggaaaaatctcaccatttcagggaaaacgagagtggggacgcatctgcgctgtgttgcaactgcatccagcaacgacctctctgtgctcctggctgtgagcacggacggtgggctctgagcttttggcagcttcacgaacccaagaaaacagcggggttttttcggttttttaaaaaatttctcctgttcctttgaaagtcgaattacgacgtgtggttccctgaaacctttcctcgcggctcgtaaaggtgaagaccccgcgtcctccaacatggtttacggcttccttttcatgtcagcctccctcatatatatatattttttttttttgaaaaagccccattatttattaatggccccttctctgttctcaaagttcctttttcgcgtgcggacacgggaaaaaaaaaaaacaccccaaaaaccatttgcgttttcacggggtgtcgggttggttttgcaaacctcctaaaaggttaccgtcgttccccgcggtttctggggcatcaatgaaaagcctgttttggggcgatttacagcgtttttccgtcggccgtgccctggaaaacttaatttctctgtttcgcgggcgggatgggttggacccggccgtttgctggtggaggcacctagttggggcgtccgggcaggggtgaggggtcagaggtcacaggggtgctcggtcccgttaggcgcgtcgtaaaccccgagggcggtgagcagtccactggccgggcgactgggccgaggatgcagagcgaccaggaccagcgggggaacggcaggaaggagcgatgggctcagaggctcccggggtcactgaggctcccagggccccgggggtccacccagctgggggacccggaccctgagatgcgggagacgtgacctccgtccctgagccccacctgcgaccccagaagtgacctccgtccctgagccccacctgtgaccccagcaatgacctccgtccctgggccccacctgtgaccccagcaatgacctccatccctgagccccacctgtgaccccagcaatgacctccgtccctgagccccacctgtgaccccagaaatgacctctgaccctgatgcccactctgtggctccagatgtgacctctgaccccagttcccaccctgagcccacagatgtgctctccgtccccaattccgagcccccagatgtgacctcagtcccgaatctctgctctgtgaccctcataaatgaccttcatccccaacccctacccgctgacccccataaatgacctctaacctcaatccccatcctatgatgcccagaaatgacctccacacctgatccctatgctgtgaccgcctgaagtgacctgcaacccaatcctcaccctctgacccccaggaatgacctctgaccctgatccccaccctgtggctccagacgtgaccgccgaccccaatccccaccccgtgaccccagatgtgacccctgtctctgccttgtgacctccaaccttgacttcgcagtcgggccctgactctgtggcttccagacctgacctctaacaccgatccttgtcctatgacctctcctcgtgacctctgctcggctccccgttctcccctcagacatcgttgctgattctccttctcgcggctcccagcgcagcctcgtgtccacctcgtggcctccctcccggcgcgtgtcgcacccacagtgccacgtctctgattcgctttgggcttactgatcgcttcccctcgttgtgtggaccgtgcagcctccacgggggcaggagcctctgagccccaggttgtctcctgacgagcgttcgagcgggcgaacgatggacgtttgttgatcgacttagtgacctccacacacgccgcatattatcagcctgtttccgaatgaggtccgttcccagggtccctttttctctcctgcaccaactttgtagcatctttgctcccataaactttcatcaaaagactaatgaacagaaagtttagaaaaatacattaatcactgaataattgtgttcggagcgggggggggggggtcccaggccggaaaatcaggacattcacggaagagaacagatttcaatatttatgaagcgattcttctgtaattaacaggagttctgtaatagggttttttttttttccggttgtcgtccttttgaatcttaattcgtaaattgttatcgaatcattaagagaaaaatatgtttcctttgatgagcccgggggtgtacccgttgttttaggtttttggatcaggttggaggataaataaacacgattagaagttttggactaattataagtctggaaatagggtcggaagaggagaggaaaatgagagagacatgtcagagggtggactgagatgagcacccgggtgctgtcaccttggtggtccacaggggaggcatctttgtgccggagacacggcgaggacactggggtgaggggcccccgtcccgtcggggtgataaacgccaggacggagaagaccgggagggtggagggtcctcaggaaaggaggggcgtctggaggccgcgggttccccaggcccaggacacggtctccatctccactcggggccgaagggagacgccccgtcagtcaggttcctccacagaaacagaccgacggggtggatggatggacggatggatggatagatgattgatagatggatggatggatgattgatagatggatggatggatgattgatagatggatagatggaaggatagatagatgattgatggatggatggatggatggatagatagatgattgatagatggatggatggatgggtagatgattgatagatggatagatagatgattgatagatggacggatggatagatagatgattgatggatggatggatgggtagatgatagatggatggatggatggatagatgattgatagatggatagatagatgattgatggatggacggatgggtagatgatagatggatggatggatggatagatgattgatagatggatagatggatggatagatagatagatggatggatggatggatggatggatagatgattgatagatatagatacagacattttatgaagaattgggtcaggcagtcatggaggctgatgcgtcccatcctctgccatccccaagctggagacccgggacagcaggtgatataattcagtgggcgtccatgggcctgagacccgggagagctgatggtgtaagttccagtcccaccaacgtccctgcccaagtcaccagcgggagacgggaacaaccccctttcctctgcctttttttctagtctgaccttcaactgattagacgaggcccaccagcacctgggatggccatgtgctttagtcagtacagtcattcggatgctcctcccgtccagaaacaccctcacagacacacccaccatcgcatgtggccaaatatctgggctcccccaccgcccagtccagttgactcctaccccgaaccctcacaccccccaacaacagtcagcgccatgtcctccctgctcaggtcttgctgggggccccccagaaacccaagaaaaaccctcctggggcagcctcgtcggagcatcggtttggcccttccacgactgtcatggccatcatgtggacaacacaggatgatcggggtgcatggagggggtgctgagcaggggtgcccacaggagatactgaggcagagaagggaggacgcagacatccacgtcggggtgagacttccctctcggccgtgtcgagatcgaaggtgtgtggcctccagaaccacgcagttcgaccctggctgttggggtgatggccgtcaccccagcagcatctttgtgtctcgaagccgtcagagggtccccgtgtccgccaaccccaacaacacccgaaggccggtccttggcgggtggcgccttctgggtccatgcagccagctcatcactgtcatttcgtgacaggctccacacaccctccaccaggtcagcctcctgggcggcgtctccattcgctcctggtgattcaaagtgccacgtggcggccggcggtgtagatgctggccgggattggcagcttttaacgggcatcccgcaccgtctagggatgcgctttgggatggaatctccaaccggggagacgggggtggatgcgcaagggggtcccagcgccccatcccgggtttttggagggggcacatgaatcgctcccccaaccctgtgtccgttttactcggtgaacgttaacaagagggagcagatgttgtggttggtgacagttggaatacagcctgggcctcacggacatgctcgggggacgacgggtgtccggtggtggcaacctcgttgcgccccgaggcgaatctgatgcccgtcaaggctgcatccgtggattgatcttcagggagagtgaatgaggccgagggttccactcggagcatttagacgctcggcgttgggaaaacgaccgtcaggtagtcattcaataaacccgtcgccacccgggtgcaaattctgttcatggccccgaaccgtgcacacccggcggggagccgcgcgcgggttcccgctttgaatcctcttcccgggagctcggtctgaagccgccgcgtgaaaacgcgtccaccgcttctagtccccgaagaaggattcgaatccgcgtcgggctggagacggccgtttgaagcgtttcccgaggactcggaggttccccgagtgtggaaagttatgagggcggcaccccaggtggagagcacgacgggaaggagggggccccgaggctgaatctcgagttcggaaaataaacggatgtgctttgtgggggctgcactgtggggcccccaaagatatgtccatccccccagggcagtctccgccctatttggaaatagggtctttgcagacgtggtgatgggaaggatggagaggagggcgtcctggaggaggcggccctgaatcaaggatggagaggagggcttcctggaggaggcggccctgaatcaaggatggagaggagggcttcccggaggaggcggccctgaatcaaggatggagaggagggcttcctggaggaggcggccctgaatatcggtttctgtgtagacggcctcgtgctcaccaccaggtccgtcaccctgtatatgtgcccttttaccccttatgcccaccccttgccccttggatcaccactcgcctgtcctctttgtccgtgtgtctgcttatcttccacatacgagtgaaatcgtatggtgtttgtctttctctgtctgatttatttcacttaacgtgatgccgtcgaggtccaatcgtgttgttgcgaatggggcaatcttgcctttttcctggctgagtagtattccactatacatatacatacaccacatcttctttatccaatcacgggtcgatgggcccttgggttgcttccacgtctcgactattgtgaataatgctgccatgaacacagaggggcgtgagtctctgaattgctgatttccagttttttggataaatacccagcagtgggaaggcggggttgtatagtattcctatttttcatttcttgaggaatctccatcctgttttccatggccccccttgggatggctgttgtctctgctttccttcatcatctgtgtgctgtgcatccattccacgcaggacgcgacacccctgagctggtgggactcctcaccacggccctgagcacccgatttgcccccaaaaacctataaacaggaagtaaagaaatatgacttctatccagaaagctcattgcaacctcccgagagggtcgcccgcctgtgcaccagctccaggaccagagctgggtggtgtctgtgtgttcacaagcgacttacagacctcaaggcggggcgctaaccagcaggccaccccttctgccctcccccgtcctgaagcccagagtctggggtcaagggtcgcagggccacgctccctctggaggctccaggggggcatccctcctgcctcttccagcatccagggctccagggtccctgagctggtggccgcctccctcccgtctctgcctccgtcctcacggggctgctcctctgcgtctgcgtctcctcttctgtctctgaggaggacgctgtccttggatttagggccgcctcctccaggaagccctcctctccatcctggattcagggccgcctcctccaggaagccctcctctccatcctggattcagggccgcctcctccaggaagccctcctctccatccttcccttcatcatacctgcaacaccctgtttgcaaataaggcatcgttcccgggtcctgggggtcaggatttgacccttggggggcccccgtttgctctttcagggaacgaggagaaaacgggtttggcacaaagaaagaaacagggagggtggcacagacgtgttgggacctggtcccggggggatgcgcgcaatttggaaagtgcccactgtgcgcacccacggcccctactgtgcccgctccgggcgacatcgggggcagccgttggcatctctcaggtccggctcgtgcggctgcacacgcgctcgccggcggtggagacggggtccgtcgggttctggtcctcgaggtgacggactctgtcgtgtttcatctgatgcgcatcctgagaaacttctagagctggtgtcagggggtctgaaacgcaggccccatattcgttgctgtgtcgacccccaggatcctcccaacggccaatggcatcttcctgccatgctgtgtaggcgtcccacatatacagtagagggagatgggcactgatgtgaggtcagtcttcctcagcaaaaaaaaaaaaaaaaaaaagagagagagagagagagagaggaggattgacagcagatgttagctcagggccagtcttcctcagcaaaaaaaaaaaaaaacaaaaccctttgaggagctctgggatggtgagtgtataaaggtgcacctgagatggatgctaagccaccaacggatgaaatttcacggaggggagaccaccccccacgccctggtccacaccgcccgatgctgggcagaaactgggagctgcgttttggtgccaaatgaaatgccagcgtgtttggaggcaaaattaaccccaagggccgggcccctccttgccccacagtcaggccgccgggcggaggatgcggggtctgcggggggcggggggcggataatgggggagtcctccatcccagtggctgatgcatcgggaaatccatcaagccattagcccgggaattaacggggtggctgcaccgccgtccgtctgattaacgcctgaataattgatcggagcgttggtttggtctccggaacgtctgccgttatttaccggcctcgtcgggacggtgcgggtttgaaagggtcccccggtcggtgctggggtttccgggctcttcagggacgaggcgagcgagctcttaggcggcccattagcctcatcggacgtgatatatggtcgtggggacccgggaacggcttttagggtttttatgagacaataattattcatttgaggagcaatttactgcgtgcaaaattccccctccctccccgtaactattttaaagtgtgtcattccgaggcttcaacaccggtccccacgtcctggacccgaccccgttatggattacgaaagcgtttttctcgccccgaatggaaaccgtgtccccgcgacaccgtcactccctgttcccctttcctccagcgtttggctttcagacctttatgatttgggcgactttgggacccggagaagtggaatcgtgcggcgtttgtcctttggtgacggggttgtttcgacccacttgatgtcgtccgggtccatccacgttgtgacctgtgtccgggcttcattctttttcacggctgagtaatattccaccgtgtggatggacggcgttctgcctgtccatccatctgtcaatcgacacttgagtcgcttccacctttcggctgctgtgcacacgggggtacaattttctgttccaaccccgcttttcaattctttgggtgtcggcccaggcgtagaaattgctgagtcacagggcaattttcatatttagcttttcgagggtggatcgcaaatgtttaattatctgtgcaactcaaaggcaggaatgccaggaataattgatatgctctggaataatctagaaacttccggaacgccgaaaagtgtcttgcctccacctaaaaaaaaacggagctgccaaataggtcggggtgggttttcgggtcttagatttttctcctgttccctagaaggtgaaatggacaaagtctacgtgagagagagagagaaagttctggaaaagtccagggatgctgaggttggctctaaaaacgagacaggtcatcgttatttcgttcctttgggacccacgttgcattcggggctccatggggccgtgtcgggtccctggtctgaaatatcccccccccccgggtgtaagaatggtgtcgaccccaaggaggtgaggactcacgtccagtgaaaccaccgtgcgtcatgctgtgaggaccggcacacggcattctgcatttgtccaaacccacagagtggacggcacccacagtgacccctcacgtcacccgtgggctctgctgacgatgacgggaccgtgtgggctcgtcgattgcaacacacggcccctccggtggggatgctggtggtgggggaggccgtgctcgggtggggaccgggggcatatgggatctctctgtgccttgctgtcaatttttgccttgaccctaaaactgctgtgaaaaatagcctgttttgggggggctggcctggtggtgcagtggttaagttcacacgttcggcatcggcggcccggggttccccggtccagatcccaagtgtggacatggcatcgcttggcaaaagccatgctgtggcaggcgtcccacatataaagtggaggaagatgggcatggatgtgagctcagggccagtcttcctcagcgaaaaaaaaaaaaaaaaagaggaagatgggcatggattttggctcagggccagtcttcctcagcaaaaaaaaaaaaaaaaagaggaagatgggcatggatgttagctcagggccagtcttcctcaacaccaaaataaattttaaaaattaatttaaaaaatttaaaaaatttaaaataaaagactgtgatccacggtacctgtctctcgtctgtcgttcagaggcgcacagagaggtcaccaccgggacagcctctcgcgatgccacgctgtgctccccccgagagtgaagcgtccgctctcccgtctgcgggtgtttctggagctgaccgcggtctacaagtcactctgtgacgctgaggggagcaggggacaggccgagcttgactcgggggtggcgcctttccgccgttaaaacggtcggcgggtgtggctcccagacgccccgtgcgtcaccccgtcctaagcgggttcacccaaaggttggtgtctgggggacccggatgcaaccaagtctaccggctgcagggctcacacgtccgtgtggacgaggcctcagggttgcatgaacccccccagcctgtctccacggactggcgtttcagggacccctgagccgagctgactgcccggttgaactcccatcctgcccacgacggctacgtgtgccaccgcagccgccccgtgactcagtttccccaattgcgacaagaagacggatgctcaggagaccccaatagatggaaagtaggcccagcgccgtggtccacgcgcatgcgcatgtgcgtgtgtgtgtctgtggctgccggggttggggggggggtccctccggctccgtcggtgggtggggaggggtccccaccgacgcctctgagccgaattagggaacctctagagccgttgtgcggcaggaggaaggaaaggggaagtgagttccccgtgggcaccgggtgtggatctccagctttcgcgaggtgggccgggttgggggtcgtgtcagggcacaaaaccctaaacccggcgacccccggttcgtgccagtgcgtcttttgtttggtgaattcgacagaaatgttatttagcaagccctg

SEQ ID NO: 38 - DNA, 2863 bp, Equus caballus
gtcctggaggcaacccgggtggagcccgcgaggctccatctggcagcaccagacacgcctccggcgcgggtggggaggcgacagggttgggttgggggggtggggggtggtggctccagggggagatgaattaagacgccaaaaaaaaaaaaaaaagaaggacacgatttaaacagcggccgggggtgtagacacgggagagccatcgcgattctcgtcgcgcgtcctcccccggcgccgcctcatttccatttcaatctgggccacatgaatgtcaaacccgggctgcaaattaataacagggagactcccgaggtcgacccagccggggatatttgggggtgtttgcgggtgatggggtaccctggcggcgctgcgcatcccactcccccacctcctgcgtccacctccacctccacccccgcccggggccctgcattttgcgccgcccgcgcgccttgaatgacattccagagaaagggcccatgcggagtgacacaaatttatttcggtccccggtgccccacgcggtgtattttcctataggatcgcggggtggggtgcgaggttgtgggggggggcccccgctatttatctggggacaatttagtttccctgaaaaatttaaatggtttccgcgcagacagtggacgggaaatttaatttgtttctcgtttgcaccggaaggtaggaaaaggggagaaggagggcgcgggggacgggctggtaggggcgctgaccccctgctgggcacccccccccaccccactggatggggactacgggtttggcctccccttggtgaccccttttgaccccaccctcccaaaaaacctccggggacaggccgccttgcaccaacttccagcccggctttggggcggctgccaatcacccggaaaaacgcgtttgcatcgatcccctgtccggatgatttatggcttcatttgagggtaattgaggattaggaagaagattaacaagagtcaacacccgggtccgggtccccggcgctaagcagcgcgccgtttgtcaagacggaacgctgggcgtcagggaggttccgcgggcaccccatcgaattgaatttgggggacgacgcgggagttaatttgacgcgggggacacgaggcgagggtatcgatccccaatcggtcctggggccgcggccccctcgagcacgcaatttagggcccccccccactcccccgcggacggcggccgttccggcgtgacggatacgacggctcctggcgtctgacggcctcggggtggatttggggggggtttccttcctggcggcggaattcgcgacgttcccattcgacgggcacgacggggtgacggcggcgtcgcctccagcgcgatgtccaacgctgagcgtttgccaccaacggggcgacgtgggagggcggggggaggggggatgtgcaagggggtgggacagggagattgggggacccaacccgctaccccgagacccccccccccagggctttctctgggctggagcatcctgcggtcctcagggagcccgtccccccatttgcatgtgtaaggcctcgctcagaaacaaggccttgtttgcatttgaacagagaggccgatgcgccgcctcaagggggctgttttgctatttgacggccgccccccacccccaccccacccccacccccacccccgcccccgcccctcgtgtgtaggggtttctccagggcccgggggtggcgggtcctcctggctttctttttctggcctcagagtgcagcagatgctgatagaaagcacaacgcagagggcagagggcagagggcagagggcaaagggcagagccccttggggaggaggggacgaggagcatggcacccccggaacccccaactcaggtttgaacccccgccgaggcctcgccccgcgctgggagggaaatcgggggaaatagagggagacccacccactcacgtgtgtcctgcaaatggactggggtcgagagcggccgccgcatggggttgatacgcatgttagggtttaaccacacacgcagttgtacacacgttcacacgcttatacacacgtccacctgcttgtacatacacgtgtgcacacatgcatgcatgcacacgtattcatacacatacaggcatatctgcgtccacaggcttgcacacacatatgtacagacatgttcttgcacacgcatctgcatgcttatccacgcacacattcacacacgtatgcttacacatacaatccacatagctatgcacacatgtatacatgtgccacacttatgtgagcatccatgtacgcgcacacatttatacacacttataagtatgcagccttatacacacatacacgcagaacacacacgcgtttgcacagatgtgcatacatgtatagatatgaatgcacaagtttgcctgcacccacatgcttatatgtgcacatacacacctgggcacactcttttatccatctggacacactcactcatgcacccaggcaatacgcattcacgtagacacatgaatgctcacttatagcaacgtgcacacgcttatacgtgcacacatttatgccctccaatgtactcacaagtctacatgcttacacacatgtacacgcatgaatacacagatttatacgcacgcagcatggttatacgcacaggcacacacatgaaaacgtccatacatgcacgtgctcatacacacacgtacacatgaaaacgcacacttgcacacgcactcacacacacatatacacagcaatacacacttatccaggcacccacatgcttacacacgcatgcgctctctacacgcacagcgccaagtgtgcaaagccttcccacagcagg

SEQ ID NO: 39 - DNA, 24868 bp, Equus caballus
agagacagagtcaaaattatggtgcccttgatggtggagtggaccttgcgaaatgatgtggaaaaaatgtagctatgtgaggtgacggatgcgttaactaaccttattgtggtaatcattttgtgacatatacatatgtccaattgtcacattgtacagcctaaacttacacaatgttatatggcaagtctatctcaataaagctgcaaaaaaaaacttaaaaaaatagtgcatattttaatgttttcatctttagagattaactcccaatgatgcagaagtagcaaaatttatcagtcatggacaccttagtgagacagaggctgttgaatatagtcatgcagcacataatgatgcttcagtcaacagcagaccacatctacgatggtggtcctataggattggcaccatgtagcctagacgtggagtagactatatcatctgggtttgcgtaagtacatgctatgatgttcgcacaacgacaggatcagctaacaacacattgctcagaatgtgtccccatcgttaagtgaggcatgactgcacttatactgaggaacctgtgaatgtgggtttatttggaagcagggtctttgcaggtgtgatgaagggaaggatggagaggagggcttcctggaggaggcggccctgaatcaaggatggagaggagggcttcctggaggaggcggccctaaattaaggatggagaggagggcttcctggaggaggcggccctgaatcaaggatggagaggagggcttcccggaggaggcggccctgaatcaaggatggcccagaggagggcttcccggaggaggcggccctgaatcaaggatggagaggagggcttcccggaggaggcggccctgaatcaaggatggagaggagggcttcccggaggaggcggccctgaatcaaggatggagaggagggcttcctggaggaggcggccctgaatccaaggacagcgtcctcatcagagacagaagaggagatgcagacgcggaggagcagccccgtgaggacggaggcagagacgggagggaggcggccaccagcccagggaccctggagccccagactcctgtgacccttgacctcagactcctggctccaggaccggggagggcggacccctggggttctaaggccccccaggctgtgtaatttgttgtggaaggtccaggaaatgaacgcactgggttagcccgtctcctcccccaagggaggccccttgccgtcgtcaggtgaagcgtggcccaccgggttccgagtcctgggaggagaggaccaagcagggaacgtcccccggctgccctcgagcatcctgctctgagccccgcccactccgatgacagacaggtcgctcctccaatcagccgggacgtggttgcctggcaacccgcatccggtgagaggagaacccaggaattctgggaaggaaccaagggccctcttcatgttctcgtcgcctttgcagatccgtccagacccggggagcgtccacccttgttggccgtgggcatgaggatggccggacggatggcccatggggccctggcgtggcctccagggaacggggcctcaaacgctttgctgcacccctcggttaatgtcgggtgtcaacttggctgggacacggggtgcccgggcgtttggtcaaacatcatcctgagtgtgtctgggagggcgtttttgggtgagattagcattttcatggatagatggagcagagcagatggtccccccccccgatgaaggtgggcctcaccaaatcagttgtgggggctaaggaaggttgatcctcctctgaatagaggaggaggcctttttgtgtcactgccttcgagacgggacatcagctgttttctgcctccaggcctcgacctgaaacattggctgttgctgggtctcaaccctgccggccttcagactggagcttagaccatcggttctccgggtctccaccacgtggacgaggacttgtcagcctgtgtaacgctgtgagccgatgctttgtaataaatctctatgtatgtacctatttatatcgtctatctatcaatctaacctatctatgtaatctataacgatctatgtgccatctatcatctatctatcaatcacgtatctatctatccatccatccatccacccatccatctatctatccatgcatccattgatcgatcgatccatctatctatccatccatccatccatctatcaatccatctatctattcatcgatcgatcaatccatctatccatccacccatccatctatccatcgatcgatcagtccatctatctatccatctatctatctatctatccatcgatcgatccgtctatccatcatccatccatccatccatccatccatctatccatccatctatgtatccatccatctatccatccatctatccattgatcgatcaatccatccatctatgtatccatcgatcgatcgatccgtctatccatccatccatctatgtatccatcgatcgatcgatccatctatccatccatccatccatccatctatccatccatccatctatccatccatctatatatctatctatccatctatcgatctattgatctatccatccgtccatgcctctatccatctgtccatccatcgatccatctatcggatgggtcccgtttctctgtagcaccctgactaacacactgagccacagggcacaaaccatttctaagtctagatgacgccatggacggacgaccccagccccttgctgtccgctaggacgttcgaggacgacggccaccccgaggacctgccctgctggggctctcaccgcgcacgagcggaattcatgtttttcctcctcccattcatttcctcgttcttccatccctgtagacgttcaattttagggtcgttcatccctgaccccataagggacccatttaccacctagaagacggtgtttatgttgaatttcctttttctctttgatcttacagcttctgccccaaacgccgttccccacagctcctcgggtcagctcccttttcctccctcccttgagcgaggttgggcctgatctctgagcagctggatttatttgtcaccgtctgccttgcatcccgggaaccctgacatctcaggcgatttaaaagaaaaaaaaatttccaatgcttaaaattccctcccggggatgtccagctggatggcttctgacaggggcccagagtggtgcgtccaccaccccgtggacacacagcagccccttgaccccattgcccctccgccccagagacccctctgactccgccggtttcccgtccacacccgcagacgaacccacgaggaaggaaaggccccggccggttgatataaaaccctcctattcgtctaatgtgcagagttcattaaacccgcatttaaatttttattgtcaagaatttactgcctcttttgaggcacttagagcgggacgtccaatattacgctgaaatttgtctttaaaagcgtcgtaattcaggggagatgagggaccccaggaaacagccggctgagggctgcgtttctgctttaatttgctgcttcccccgggggtgtgggggagaggaaactgggagaaactggttgaatggggccccacctcctccccccaaaataaagtcatgtccactgggacccgggatgggccttacctggaagcagggtctttgcagctgtgacgaagggaaggatggagaggaggccttcctggaggaggcggccctgaatcaaggatggaggcagagacgagagggaggcggccaccagcccggggaccctggagccccggacgccggaagaggcaggagggaccctcccctggagcctccggagggagcgcggccctgcgacccttgacctcagcctctgggctccaggacggggggaggctgggtctgtggggttctaggcctccaggtttggggtcattcgctgtggcggccccagggcctttgcacaacacgatctagtgtgtggaggcctggaaggctgcaactgggaccccgggctcctccgatgggcgttttcccaggctgccttgcacgtgggcagaagcccccggaacccgcggcggggagatcttgacctttgttgacctttgtgcacggcagcgtccagcaggttccccccaaaaaagcgttttgttcaaagcagccaatgcacttatgtctccacggagtctttgctcccagggacctgcagcccgatcatccgggtcacttggggaccccgaatgcaccccccttgtgcgcggggctcccgggtttgcaagaggaatgctctgcatctttaccagcaaaaaaaaaaaaaaaaaaagtgacaagtgcttttctcgccttcaataaaaaagcgcttattcccctgaatgtgggtaaaacgtttgtcgttgcacctgtatctgggctccccccccccgaccccccgcggatgagccgaccatgtcgccccccggaacccaataaatccagcggcggagaggatggattcgtccgaaatgaaattgagtcctcagctgcttttcattacgggggccctcgaaaaaataaatggcgtttccgcgggttatttatgcgtccgcgggggcgtaatggccgtaatgattaataccgaattttctgaatttattctaaaaaggccgcttcataaatatggaacagcgtgtgcgccgcgatgcgcaggtagccccgcgcgcgttttattaaaatggaaattcaggaaacatccataaaaaaaaaaaacgacgacgacggcgagcgttttggagacaggcacccggggggagggtggggggggggtagcctggacgcgcatgcgcagaaggagaccccagacttgggggacccgtgtggatttcggggggacgcatcctgagctgttggggtcctaagtggggcagggaggccaggcctggaggagagttgcccccacgtgcctgggaggaacattctggaaagcttccggccatggaggttcccaggttagaccatccgacctggtgccagctccccttgggggggggtagtggctgcagcagagcagaccccgggttccagattctgacgggtcagaggtgaagggtgcaagcatgggggactctggggagagtcaggcacgagcacttatggagcaccgactgcataccgtgctctccaggttggaccctggggctcctctcaggctgggtccaccctccatgttgtgaagcaaggaaattggcgatgttgtcattaggggtctttagagtcttggctgtgcagcctcagatggggaagaaatgaggggatgagccgcccagcccgttggcctgacattcaaggcccctccaagatggccgcaggtggggggggtgacatccagctttctgtcttctccatggcatctgctccggccacactgttcccggcagtgcccaccagacaaacggccgggttatggggttcgggggctggcctggcaccccggggtcggcatcgaagggcgcagataccaccccaggtgggacggggccagaggacggagaagacaccaggatgcagagctcaggactgtgggtcccaatgggggtccacccgggccagagggaggggagggaacggaggcccagccccttggtgcagcttattccggacggaatattacgcagccctgaaaaaggaaaagcggttctgaccacttgctgctggaggcggagggtggggagaaggtccggcaccgagagtgaataatcctcatggaaactgggggtccgtgtgggttcattgattgcaaccaaggtcccatcgggtgggggacgttgataataggggaggccgtgcctgtgcgggtgcatcgggcttatgggaaatctctgcaccttcctgtccattttcttataaacctataattgctctaacagaaagtcttaaaaataactaaaaatggttcggagggtaaattgggcattatggacaatttatcagcattaaaaaaaaaaaatccagtggtatttcttctttggctgaaaatctcccggtggacacggccagcatcgggccccctgccgtgtgggggtgaccgagggacccccggcctgaagggcgcgtgctgtgcgtccccgagcagagctggttcgggtccgctcgtccttgttgcgattcactgaaagtgagtcaggaggtcctagtggacccccagctcctgagccgtttcctcgttcgaggagaatcgtttcatctccttctttttctcaaaaaaatgcagaccgttggcccgtcctcgactcgatggattggcccccaggacacagctgcatatcctaaaattgtgggtccttccagttgtttccgacgagaaaaggagttcttttcccggcacgacgggagttaaaacaggtaacaacacccgctcttcgtgtgaaagggagaaaatgattttgttttttttgttttttttttcgtaaaaaaaaatatcctgggggcagttgggagaattaggcatcatctcggacggcgcggttttattgagtcagaaattcaataaatacggggtcccggctgccggcgggatgagttattagaatcgtgtcgaggggatcgggacagaagctcctggatgtgggaaatgagattatgggggggcggctgcccgcggggtgaggtctcatagtcgctcggtgcaccttaattatcgtggcccgaccctctgccaccccatgactcgtgtttcttaatatcctcctcacggattctcctttttttttttttcttttttgcggaccccaatctctctccttacagctgaacggggagaatatttattcacaggcttttttttttttttttttcggaataattgaccgacttgaaatccacctgccggacaaggagccgtttttttttcagtgtaaaagtcagtggtgtgcggcacatttgtgatgtcgtgagaccaccagctctgtctgcttccacatttgcccccaaggcgaccccgtccccatgagcggtccctcccagccccggcaccaataatccactttgtccccgtggtggatcggcctgttgtggacatttcctatcaatgggatcctgcgctgtgtgtcctttggtgtctggctactgtctctgagcatcgtgttttcaaagtccatccacgtgtagctgcagctgcgcttgcctcctgttcatggctgcgtaatattccaccgcccagctgcatgaacatgggtgcacacgttttcccggagtccccactttcaatcctcttgggtgtctccccgggggtcaaatgtccaggtcacgggggaaattgcacgtttccctcctggacggacctacccccgggtccttgtcccgtttgcagggtgagcagaaggtgaagggcccacatatgtggatttaacccgagattttcccccaggaggcggtgcccgtgacggcgggccggtcatcgaatgactgagtgaccacacggggtggaaagtggggatgttagcggagaaaaacggaagctgctggcagccccggaggaagcggggtgcaggccgtgccccccaccgtaggtccgtgtgcagagttttaacgcccccaaacgggggccggggacctcccccaccccgagcgagattggctcccccagaggacccaggcgggaactgggagaactttcccgaacagcagccctcggtctgggagccccgggacgccccccccccccaccccgcatgagctgtgtctgtgcctcgaaacggcagccaagcggactccgataactccattacccggatgcggcggggtccgcgtgggcggctggggtgcaggcggcggcgtaatacaaagtgtcagctgaaatgaaaatacagcccgggtaattacatttaattggatcctgtcactttaaatcctcttcgttcgccggggtttccgcggaaccggggcctccggggcgcgcttggctctttattgcgaagagcggggctgacccccgtgtttgtgggggggggcggtggggctccgaacacgacccggggtggggatgggtgcggatccggagacccgcggagttttgttggactttgactccccgctgggagagtgtggtggttacaacgaaatcccggttctgcgaaaagacgccgagtgtgcgcaacgggatggactggaggctgcggggaaacagtgtccacagacgggcaccgtctacactgcgggaaacataatatccacggacaggcaccgtctacactgcgggaaacatggtagccacagacgggcaccgtctacactgtgggaaacaacatccaaagatgggcagtgtctacactgcaggcgccttggagccaacctctccactcagggcaccgtctacactgcaggcgccctgcagccgagctccccgctcagggctgtgcgcacgggaacccgtgcacctcctacggccacttccgggacaccagagcgcagagctgacggccgacaaacgcacccgtttattctgcgtttgacgcgtttgggacgccggccgcctaaacgggtgagttcacgcccttggggccccgagaaggcggcctggttgggacaaagcgggttcgcggacgcagtgaggtcaacagaaggtcatggggggggaacctgctccaataggatccgcgtccttccaggaagaggaggaaacacccggggaagatgcagccccgggacgctgcgtctcctcttctgtgtctgaggaggacgctgtccttggattcagggccgcctcctccaggaagccctcctctccagccttgattcaggaccgcgtcctccaggaagccctcctctccatccttgattcagggccgcctcctccaggaagccctcctctccatccttgattcagggccgcctcctccaggaagccctcctctccatccttgattcagggccgcctcctccgggaagccctcctctccttccctgcatcgcgcctgcaaagaccacaaggaccgggtgtgcactgatgaggtgtggcccaccggccatgccgggacgggttgtggttccttcagcctctgccgccctgaaatcagggagtttgacgacccgtctggaaggttcgtggcggcgctatttctgttcacgggtcacggtggaatattacgcagccctgaacaggagcaaagccccgacacagcgacacgtggacggaccttgaacccacgatgctcagagatggcagccagacactcaaggacgcacagtgcgagatcccgttgatgtgaaatgtccagaacaggccgatccgcacacagaaagggggtgagtgggtgtcgggggctggaggcaccaagaacggggtgagtccttttgggggtgatggaaatggttcagcaccagacagaggtgctggatgcacagtcccgtggattcactcagtgtcactgctgataaattttatgttatgtggattttagcaaaatgaaaaatagtaaaaaatcgagtctatggccacgggattctggaacattccatggaaggagctcatagggggatctgctggctacaccttctctgccctcagtttccccttcggcttggggtcggtgccccgcgctgggggtggggggttgtggggctcccccatttggcatcatttgaacctgaaactcttctgcaaagagagagcgggtttcttaaaacggatcagggcgcagagcgtgttggaaacgggtcgtattccacctgatcggctgctgcattattcacgccccctgtgaagacgggcggaagtgacgggtggtggttaatctgggggaggggtgcccggtgcctgtctacacccaccctgcccggtggtcgtcctccaggctggatgtggtgatggacggcgccccactggcgcatccagagcgtttgaggccggacaccaccgcacctgttctggggttttggaagagtcacacgagacttttttttttcttttgaggaagattggccctgtcctaactgttgctgccaatcctcctcttttttttttttttttttttgcttaggaagactggtcctgagctcacatccgtgcccatcttcctctattttatatgtgggatgcccgccgcagcatggcgagccaaggagtgccatgtccacaccagggatcggaactcgtgatcccccaagccaccgggctcccatgcgcgagagttttaatcgcacgtgtctgctctgctcggttgttggggttgctgaccacgcgggtggaggcagcacgcgtccttccggccctaaaaaggcgccaacaggccccgtcttctcactacaaacgggcggaatcgtgtccgtttgggatccaaatccacgagtcagccccgcgccgatccgcgttgcagcgcacgtcgcccctgccggcccgcgtctacgcagcgcctcccgtatgccccgccccccgtccccgcgctccgagctccaacccgctccggatgcgcgcgggagccgccgccggtctccaccgcccgccaaccccacccggtccccgtctgatgtgacaatgacaaagggctcggcgccgactttaaatttcataattttaatccgtcaagcctgacatttaattagtgccctttcgcacccgcagccgccggggggtcccccgcggaaaccccgccccctcctcccgccggccccccccaccccaggcagaaaaccgggttcataaatatgtgcataacttgcaggcggaagacaatgcgcccgccaggctccctgcgcccccggcggtggagacggccccggaggttaagcgtgtttcgaagactcggtttatggcgttaggtccgggggccagtgggtcgtgggaaacgagaaacaggagatgtgggaggcggccgcgagtgtggaccgcgggccagggcacctcgcagcatccggggatcccggggcgtcgccggtgcagtttgcaaacaaggggaggcgagcggggcgccctgagcggcctcccaggggcagggaggggggtgcggggctgagcgggtcttgactcatctggggggcgaggacggggtctctggaccggcatccggggtggtttcacccccagaggagccgaccccacaaggcccgtcttcctttgggtccgagctgctatgtctcgtcgtccaaacggcaagcgtttccatcgaaactcgaccggaacctctttccgactcgggggctgctggggcattttgtcaacaccgtccagcaggaggagagtccacaccggctgctgacagcgggtgggggctcccggggtactttacacaccacatgctttttctttctttctttctttctttttttttgctgaggaagattggccctgagctaacactagcgcccagctccctgtattttatgtgggaggtcgatacagcagggcttatgagtggtgcggaggtcggcccgccaaccccaggccgctgaacccgagtgcacgacctgaaccactgcaccacccggccggcctcagctgatgagagtgggtccacgaggtcgggggcaggtcctcatcttttctaagctgagcttccttcttttggggttcgggagtcagttccagagacaggaacggggcttcagcgcccaccgagtcggtccccggatgaggggtccctggagcacttgggcccctggaggaggagagggctcgccctgtgcccctgtgggcctggctgggccgggcgggtgcagggggaggaatgaaggaggcctgccgggaggaggaggacctggagcagcacagccaggtgcattctgggaaacaggaggagtggggcctgggggaggaatgaaggaggcctgccgggaggaggaggagctggagcagcacaggcaggtgcattctgggaagcaggaggagcgcggcgtcgtgagaactggggtgcagggggagcaggcgtcctgggccgaccccgcccgccgcccccagcacccgggacctgctctccgtccttccttcccgacacgctttaggggagaacttgcatcccgaggctcgcctgtgggcgtgtcggatcacaatcgggtccaaggccaatgacacgggggtgaggggaaagagtggctcccgtttggggtgacggaatgttccagaacccaacacatggtggggtggctctgcgacacagtcggtgtgctaaacgcacccaggactgtgcccctcaaacgcttgaaatggccatttctgcgacccgtgtattttcccagagaggaatgtggttccgattctcagaggccccgacggacacagagacaccctctgtatttgtttgtatgtatatatttttttttgctgaggaagattggccctgacctgacatctgttaccaatcctccttttttttttttttttttttttgctgaggaagattggcccagagctaacatatgttgcaaggacaacctccagctcaatggttcaggactcatatggcctatgacaaagaacttgccattctttctattgattgactattgttatgttttttggtgaggaagattggccctgaattgatatcaattgccaatcttcctcttttgtttttgttttttttttttcctgctgaggaagattggccccaagccaacatgcgttgtcaattttccacctttttttttttttatttttgctgaggaagattggccctgagctgacatccgtgccagtcttcttctgttttgtatatgggatccgccagccacagcgtgacttgatgagcagcaggagggtccccacctgggatcctaaccccggaagcctgggccgctgccggacggcacagcccacggagtccacacgggagggtccatgtgggtttttttcccagccgcatgccctgtacaccctgtttgcaattattttcccattaagtgtgacccctggacggttgggggcacgggaattaggtcctcggaagggcgccgagccgtgtgcactgcaggcagggtgggggtggcgagtggctccctgagctctttttgcttccacttgtcatcctcccaggacggctgaaaagtcgcgtttgcatcctaaacgccgccatccgtcctgctgaagggttctgaatttccccaaagcggggctgagaagcggattaaaactccagccatcaatcctgcccggggcgccataactgagcaccttgtccttgcaggacggactcggcagaagcaatcatccggggaggggacgtcgggaaaaactgcacatgcagaggttggcccggtggctcagtggttaagtgcacacattctggtttggccagtcttcctcagcaaaaaaaaaaaaaaaaaaaaaaatgaggaggattgggagcacatgttacctcagggctaatcttcctcagcaaaaaaaaaaaaaaaaaaaaaaaaaccctcactcgcaggtactcccaggggccggcgttgtctcccattttccctaatttccctttaagtctcaatctgcctccattggattaaagaaaataaccagcgttcctaagacagcgtctctggtggtgttttcaggacgccgcgtgttgggttccccgagacgaaagatggttttaaaaatggccgcaggtgatgatttttttgtagcttaatttagacgatattgaaaaatgatgagggggggaaagaaacggaagccgcctcattaaacatccccccccccgcttttgcaatttaaagtcccggctccgccgtgcgcgtcgcgcgttcatatttcaacaataagcgttaataacacgggaacgtcgttatttgcataacgcggctctaatggacccgggggacctgcaagcggtgttccgtccgcgatgatttccgtgaggatgagcgggttttggagaaaacggggggcgtttctgccaggtgggggcctctctcccctccggcctctctgctcaggggggaaccagcaggagacagggactcagcgcatcacggatgccagtcttcctcagcaaaaaaaaaaaaaaaagaggattgacagcagttagctcggggctaatcttcctcaaaagaaaaaaaaaaaaaaggaaataatcctaaaccccgttgtgtccccggacaccagctagtttccgttcctcggggctccggccggagtttcctcacgttgatctgctctttctgccttttctacggacacttggccaattcacaaacaacggagagagacgccccacccgggaagcgggacgagttccaccggctcaggttttcagatatttcgcgggtttttcggtctaattagccgcatccacgcgatgcgcgtctttgaggattatttatggggcgaggactgtggttttcagggcgggagcctgttgtctctgttttcgcgggtccaacgatgctcccgggggaaccttttcctgagtcccagcccgagcccagcagacgtgtgaaccgagtcgaaattaaaaccccccaaagtcagtctacaatttatattttatcataaggatctgttttttaaaggtggctcccaaaaccaaagacactgaattgcaaggaagttggaaatccatcttattcaaagtcttttttttttttttttttgctgaggaagactggccctgagctaatatctgctgccctggggctggaggcctcggctccgtgtccgtgtgaggaatgggaatcgatttctgcagttgatatggagcctgtttatgcagaaataggagcctgagccagctcagcgccagtcttcctcagcaaaaaaaagaaaaaaaaaaaggaggattggcggcagatgaaggcctggctgccgtcagatcctccgggatgacgggtcgactgggacgtggacgtgtgttttcgtgggggcacaattcaactggcaaaggatgtgccatggagggcaagctcggatccttcctggaggaagcggaaggcgatattttaaggccatttttcctttgcaggatgaggcccggaacccagcacagaggagaccctggaacatcccagagtgacttacagaccgcacggcccaccgctctccctgactctcccgtgctaatgtcatggggtcaccatatgccgtctgtcgtcgatagagacatcgtgacgtgtcgcgccactggaaacacgatttattgggttttgactctcagttaaaagtctacgagtccggtcccgatgctcccgttgcaagaggggagggaggcccagttacgtctggaggggcgctaagtggcgatcggaaagtcaatcgacaaacccgatgctttcttctgcagccggggctcctccctcgcagccgtttttctttccgtcccacgctcacgcttgatcctaacggttggcgccatttttcctcccggaagcgtgagctgcgcggggccagaggcgcggcctcgggttcggttcctgcaccggtctgctctgcggggacgacggagatcacgggtggaggcaagcgggtcccgactcgcggggtccccggcggcccgctcctgctgaggtggaaacgggccctgggcggatgtgaacggatccaaacgggccctgggcgggtgtgaacggatccaaacgcgctctccgcgggtgtgagtcagacacacgtttcttgggggatgtgagtcggacccgctcttgtccgcagtaattggaagggtggtccccgtggggcgcgcaccccccaggccccgaccctgcgccaaagaaaacgcccgttttctccattttcctttttcctgcccatttgacaaaattatattccatggggccacgcaatgcaatttctgggataatattcaaggaagggggagagaagaaaaaaaaaaaatcctgcattttctttcatttctgtcagaatcaatcaaattgtacgaaagggaacatcatctccgagaaggaaaaacgagcgtttttccggccggatcagcgtcctccgtgcgggaacatgcacatattgaagaggtctccgttttcccgtttttcttttttttctttttttttttaatcatgcctaattagttttttttttttaatcacccacacaagtaagacgctcgcctgcataatttatgacatcgaggggcccgtgtcagaaatcaaatgttgtaaattaaaaataacaagttggagacgagtgattcaattaaaacccagaaaacattggattatgcataattgagagcttgtacgggggggacgcgtgtcacccctgtcagctcggatgggaagattgcattggggctgtcagggccgtttaaatcaaacgggtaaaaaaatcggaaaacaaagatgatgtttcttatgaacttccagcgttcggaaataacggccggggtgtctgcaaattgaatgcttagacgacgggctctatgtggagggcacgtgccaggctccggaggccgggccgggggaacggggagcgtccgacggtggccgttggagggcaccccgggaggagggggggtctatgcaggaccgggggcaccccgaggacccccatctgggtccccatcacccacccctgaaatttgtcttcttgatgatgaaggcggctccaaacgctcagcgtttcccggaagcagcgtcgtgatttccagaaattcgcacggggagcgtccgcgtggagactgagtcctggtgcccccggggggaagggaaacggaagctgcaggcgagtccttgggtggggggtgcaaggtcccatcagaaaacggcacccaacgatgagcgttttggctccataagcggctccaggggggcgtcaccaacggcaccccccgtttgcgtgaggaaggacccaggagcacgtggccttcgaaccggtgtccggtgggtcagcgaggaacccccccccccaaacccgggctaacggcacagaggacgctgggcgtccgtctaatccgccacgcacagagcggggctctgggacagccgtctgggctctccgtgcctcagtttcctcttccgtgaatatatatagagatatgatacatttctataggcagagatagggtatagatataaagagagagataaagacgatcaagttatagctatcgatagacgtagagttatagatcgttacagatatagatatagattcaaatatggtggtggatatagatgtagctgtagatacggttatagatatgacgtagctgtgtagatatgatatagttttatagatattatagatatagttgtagatatagttgtagatatagatatgatatagctttatagatatgatagttatagatatggcatagatttagatatagatatgataaaatcagatatcaatatgacagagttatagaaatgatagagatatagatatgatatcgatatagatatgatagttatagatatgatatcgatatagatgtgatagagttatagatatgatatcgatatagatatgatagttatagatatgatatcgatatagatgtgatagagttatagatatgatatcgatatagatatgatagttatagatatgatatcgatatagatgtgatagagttatagatatgatatcgatatagatatgatagttatagatatgatatcgatatagatgtgatagagttatagatatgatatcgatatagatatgatagaattatagatatgatagaattatagatatgatggagttatagatatgatagacatagatatgatattgatatcgatatagatatgatatagctttataaatatgatagttatagatatggcatagatatagatatagatatagatatgataaagtcagatatcgatatgacagagttatagatatgatggagttatagatatatcgatatagatatgatagacctatagatataatatcaatatcgatatagatatgatatagctttatagatatagatatgatagttatagatatggcatagatatagttatagatatagatatgatagcgttataaatatggcatcgatatagttacagatatagatacagataatagttataaatatagatatatagatatagatatagatacgatataactatatagatatagttatagatatagttgtagatatagatatgatatagctgtatagatatagatatgatagttatagatatggcatcgatatagttatatatatagatatagataatagttataaatatagatatattgatatagatacgatataactatatagatatagatacagatatggttatagataaagatatgatgtaggtttatagatagagagttgtagacagttatggatatagcgacacagatacagatatgatatagttatagatatgacatacttatatagataagctatagttacaggtctagataagacacaacatagttttagagatatacatatgaaaaagtcagatgtagatatgaagttatagatatgatatagatacagatatgatataggtatagatatagatacgatggagttatagatatgatatagatatagatgggatggagttatagatacgatatagatatagatatagatatgacagagttatgtagatagagttgtagatacagatgatatagtttgatagctatagatgtagtatttttatagatatgatatagctatttagatataaatattatatagttatagatatagatatgacatagttatagctacagatataggtagagttatagatacggatatgcatagaatgatagatacaatatgatacagctctgtcgatatacacatgatacagagttatagatccagtatagctatatagatgcaatatagttatagacatagacatatatttatggataggatccagatatagttaatgatctagataaagttattgatccagatataggtaatgatccagatatagttattgatccagatatagttaatgatctggatatagttaatcatccagttatagttattgatctagcgatagttattgatccagatatagttaatgatctggatatagttaatcatccagttatagttattgatctagatacagttattgatccagttatagttattgatctagcgatagttattgatccagatatagttaatgatctggatatagttaatcatccagttatagttattgatctagatatagttattgatccagatatagttattggtctagatacacttattgatctagatataggtaaggatctagatatagttactgatctggatatagttaatgatctagttatagttattgatgtagatatagttattgatccagatatagttattgatctagatatagttgtgggtctagttgtagatacagatatagactgactacccgacggtgcactgtcttcttgtccccgtttcctcaggtccagtttgggcacattcatcgtctcctgatccaaactcacgtggttcctgcacgaatttccacctccccccggctccttcctcttctgcgctgacacttctctctgtcgtattcccgtctggcgtcgggctgccggccgcacgttttctccatttttctcttctgaaaacgtcttgcttccgcctgttgggaagtctgcgtggggattctgttgattgatagactatcgttctgtgtcggtcaaaagaaatcccgaacggcagacagtgagggcgccgttagacctcctactaaggagcagggagaaagccaggaggcctgcccagaggaggaagcacgtgaggaggcggtgtcggcacaaacccacgtcttgcagacaaaagggcacgacctcggggggtgggggagccccaatggtggggaaggtcccaacgggggggaagggggaccccaatggggggggaggtcccaacggcggggacgccctgagcagtggggtcccggggtcccaggtggccatgcaccctgtcctttacattgcacggaccccgcagtgtgcacgggggtccccccccgtcttccagccggcagtgacctttgctcctgggcccccccttctccacaatagcacgaaacacctcagaccgcggccaccgaggcgccttttaagccactgaggagatctgagcagaccgtttgggggcgtgtcggcccctctccgcccccaaacgccgaccccggttacgatatttcctacaaacccacgtgccggggaggcaccgtccacgtcctccctctcgcccccatgtctgtttcatatatgcggcgggataaggtggtcgtggggtctccgtgtgtctcgtggggcccgtcctggcgtttgtctccgccccatggctgacgggggtcggcttgagtcctgtccgacttcccacgtgggagacgtcccccgactcagggcctctgaacggcacctgattgggaaaccgggtcggtgcagtagccattagggaagttagcagtcgcgagggtggggcctaatctgacgcccggcgtttcctgtaaaaaaaacggcaaacggtcacgtgtctggagggacccacgggaggagggcaggttcccctccaccggcctcagaagcaaccagaccctgacggcgtcggagtctggtctccggaaccgggaggcgataaacgatcaacgtctgtggcgtttggcccccccgtttggggtcgtttgcggctgcagcctcgggaaacgcggaagccgggtgcgcgaatccatcgatcttatgatccgtgatgcgcctttggaacgacgtgtcctcggtctccacacgccgcgtctacacagcacggaaagagccgggaggcagcgtccactctcagtcgtaaaatacggttcatgagtcacactcagaacacagggaaagtgtagacgagagtctacacagaactctgagccattgttgaggccgaatttttggggtcaggcaggcggcgtatgagtggtgggggtgatgtaccccaaaagcacccccgggcccttcccactggggccaccaggccgaccttgccctcgtcctgctctccgtcaggtccgtgtgtgtctggatcaaaagggcagcgtggagcataaacgcacctgtgaatgtgcgcagagtctgttcatttaaaaaaatctggtttgctcaaagatggtaactgtccacgcagccttctcctctggagcctaaagcagcccacttgctatttactattttttgtaaagaatccaatgggcatcacaaatttttttttttttgctgaggaagattggccctgagtgaacatctgttgccaatcctcctctttttttttttttttttttgctgaggaagactggccctgagctcacatccgtgcccatcttcctctactttatatgtgggacgcctacaacagcatggggtgccatgtccacacccgggatcccaaccagcaaaccactgaagcagaacatgcgccaccagccggccttttttttttttaacatctttaaaagtgtgtgtgtcccgggatcaggttcctaaagctgcacagaggacaagcgacacgacgtatttatttcttgagactgttgcctcaaaccgtgtagatggacagaaacgagttctggggcctggatcctgctgggatggggagggggggggagccgtgtagacctgacggctccgtggaacctcccagaactgctgagacgcacaggtttgcaaacccgaaactgtgtcaagcgcggaattccccaaatacaacatcagacagacttcaaagccggcgagtctgcccaccgacaacgggaacggtgttaattagcaacaatgctctttaatctataaataataaagtgatcgcggagctccccggggaggggcaaaaaagaaaaaattaaaaaaaaaaaaaaaaacaggcacgtaaatcagtgcacagactgaggtcagcgcccgagaccaacgctggccgtttcctggaaaccgtttttggcgtttggcagaaagagtccgttttacaaggggaagggggttcccaaattaagatgcgtttgaaggaaatcccccgtcacccctcgatagacctttggggatgagaccccgggggagctgttgggtccttgggccgggggatcctgggaggagccaagcgacctcgctatcagactaaccagaggaaatggccattttgatgtcttgaaaccccccggaaaggacatttttaaaggaaaaaaaaaaaaaggttcgttttaggcagatacaaccatttgacctaataatcagtcaagatttacaagaagcgtttgtgtaaaatgtatgattccatgtgaataaggaacctgtctgttttcactgcttttcatgtcttgtcactgagaacggttttctcctgggaaacgatccacgtattgattgactgacaaaacgtcgtgtgcttttccgtagacccaaagggacattctttctagtcctttctgaacaattgcaaaatctgaaagtgaggtctcaattttagtcttttttttttttttttttttttgctgaggaagattggccctgagctaacgactgtttccaatcctcctctttttgcttgaggaagactggccctgagctaacatccatgcccatcctcctccactttatatgtgggacgcctaccacagcatggcgggccaagcggtgccatgtccgcacccaggatctgaaccagtgaacctcgggccgccaaagcagaggtaaaggggcacatatgtatggtgatggaccaataataatgtacaactgcaatttcacaatgttataaaccatgatgaccctcctggctcatctgtcctcgaggtgccatgatgttgactctttgccccgtggattctttgtgttttctgagtcaaacgagatctcttccccacagggaatttttccccccagtaattgtatcgaggtcatagtggtcccctcgccttcttcctccccatcgttcgttccaaccgccatgcctggcagccccctgaccacagggcctttgcacagtctttcccgtccttatttattcttatttttttttttttttttgccatatctcctcttacaaggcaggtgctcacactttaggctttgaataagcgattaagtttccatgaggacactttttccctattgaagcctttttctaaataaattttaaaatggctgggtcgcatcccaagccacacgcatgtcgcattcaaacaataaattcgtaaaaccgctgaatgttgctcgtggtgcaaagatagggaagctgccatttttttatttttaaatttttttttcttttttcaaatttttttcccttttttttaaatgctttgattgtgaagaaatcccccttaagctattcaggtcacccgcgatgaatgcggttccccttgttctctgagggaagaaaataaacacggcaagtggggtctgcgtgtgacactgggaggtgagttttttttttgcatctgaaaaacccggggctgaatgtctctctctgagtgaatgaggtgtttaaaaatcatcatttctgtttttcctcgaaaaaaagcaaaagacgtcatcgcgagtctttccaggatcatggttttcaatgcccttcgacggctgggtcctagaaacaaactttttaaaaaaatttttcctactgcgactatgacatgatctcgcgaggttacgttccgggatggtgagacgacccggaattctctcgtccaccccgcaccctctccatcctggaggtctcgcgatgattcctttcaatccagcgggtgctgaacggtctcacgggttgttgattgacaaagtgatcgactcttccaataggatgagaagggctcaccggcaggtgttcacactcgctggcagggatgagtctgcccgttttccccacattcgcattcaagggatgatttctcgcctcccccccggggaccccagaggatccaaaccctccctcgcgctcgccgtttaaatctaacggtccgggaaactggccccgcgggtggttctgagcacctgtggggtgaagggacgacattcctggcggccgccgtccagaatggggttcccgtgggggacccccagctcgggggtcaggagggggtcaggccctccccccgcggtgtcctagcagaaacccctataaggccgagcgactgcttggtccacaccgcgcgtcctcgggaaggatgtcggatggcagtttcgggtcaaacgctttccccaacggctggggcgggaaacgcgaaaaacggtttagttcctggaggatttaatggtttccatctgggtcccttcgcgcacgggacggccgcctcgtcttcacccgcgtttacccgcgtccgcggcgaatcggagaacgagcgcaggtccggacccgccgcgggtttgtctgcactcgcaagatggacctgagcgttacaagaatccgaatcggtgcttcctcggcggcgctgggcgcgggtgaaggaccccagggtgcggggcgccggcccaaagcactgctgcgaacgaaagacgttccccggggagcgcgggtcccggcgacgggggtgaggatgaggatgaggatgaggatgaggatgaggaggaggaggaggatgaggaggaggaggaggaggaggatgaggaggaggaggaggaggaggatgaggatggtgatgaggatgaggaggaggatgaggaggaggatgaggaagaggatgaggatgaggatgaggatgaggatgaggaagaggatgaggatgaggatgaggatgaggatgaggaggaggaagaggatgaggatgaggaagaggatgaggatgaggatgaggaggaggatgaggaagaggatgaggatgaggatgaggaagaggatgaggatgaggatgaggaggaggaagaggatgaggatgaggatgaggaggaggatgaggaaga

SEQ ID NO: 40 - DNA, 1595 bp, Equus caballus
ggccagaagtcgtccctctgatgatgcacagccgaccccacgtggttgtctctgagccccactttcccccccggccccgtgtccgtggaaacgccttcacccccgtccccccgcggccgcggggaggaaagtcgggcgctcgctgcggggtccccaccgcgtgtccggggtccaggagccgctgccccgctcgtgcccgctcctcggggcccaggccagacccgcggcctccactcgcggccgggtccctcaaaacgttcccgccaagtggtcctgtcgattcccacagatcgacggggttgttcgatgacccctgtctggtctcagggtgattttttttttttgaggaagattggccctgagcgaactgctgccaagcctcatcatttattttttattttttattttttagagccagaagaaggtaagagacgacctcagcttccttcccgaggaaaacgggcctgtgaatttggggtcagcccctgaccggtttttttttctatttttttttcattgatggcttattacacacggtataaaattcaccatttacagcaaagtgagcaatcgagcggcgtttggtgcgtccacactgctgtcccaccacagcttctgtctcattccagcgcattttcatggcccccgaaaggagaccccaaatcctgtgacagcatctcgggccctggagaccacccacctgccttttgtaagtggctccggatttgcctgttctggacattttgaacagagaggtcatacgctgtgtggccttttgattctgaccttatttctctgcttttcccttcagtttttcaggtcacaggctgtctccattctcagaagattctagaaggttctaggctggcaacccagagggttggcccccaacctggcgcccagcgtcccccggatccgaggagcaggacgtgggatcttaacccgaaaattaaaaagacggctcctgcttttcacagggagacgctttttctgcagaaatatccttatttcgcgacttcattagactgaacccgtggctaaccgtttctgacgatattccaggaaaacggctactctttctatttctacaagtggttgttctttgtgcgcttggttgattgcctaagaaatctcttcgttggataaacaaattgggaagccacgctgtggtgggcgtcccacatagaaagtagaggaagacgggcacgggtgtgagctcagggccagtcttcctcagcaaaaaaaaaaaaaaaaaagaggaggattagcagcagttagctcagggccagttttcctcagcaaaaaaaaagagagagagagagagagaggaggattagcagcagatagctcagggccagtcttcctcagcaaaaaaaaaaaaaaaaaaaaaaagaggagaattagcagcagatgttggctcagggccaatctttcctcaaaaaaaaaaaaccaaaaaacaaattgtgctgtctctctctctctttttttttttttttttttttttaagaaagtcaacatttttatctttagaaactcaaaccgtttgtcaatagcctaagaggggttctgggtcgcgtcgggagaagccccccccc

SEQ ID NO: 41 - DNA, 2143 bp, Equus caballus
tgacctgacaaaatgcactgccttttttttttttttttttaacacactctattaattaaattttttattaggggaaacacgtcgcaaaattatatacagtcaaatgtaacgtggacccaaatggtgtataaaagaaaaccataaaaattttccacttaaacgatttttaaatgcacagtttggtggaattaagtccattcgcatcgtggtgcagccgtcctcaccatccagctccagaactttccgtcttcccaaagtgaaactcagtccccattaaacacggagtccacatctgctaccccagcccctggacccactgtctactttctatttctatgactctgagtcctggagggacgtcctagaagcagaatcctacaggatttgtccttttgcatctggcgtatatcactgaacatcgtgtcctcaaggtccagccacattggagccggtgtcagactctccttcctttttcagggctgtgtaatattccactgactgcgtggatggagcacattctgtatatccatcatccgtcaccggacacttgggttgcttccacctcttggcgattgtgaataatgctgctatgcacacaggtgtgcaaatacatgttcaaggccctgtctgcaattctttcagctgtgtacccagaagtaagattgctggatcctatagtcactctatgcttaacttttttctggacctccgtatggcttcccacagtggctgcaccattttacattcccaccagcagcagtgtaccgggtgccagtttctccccaccacttacaatttcacttttgacaatagccggcccaatgggagggaggtggtggctcagggtggctttgatttgcgtttctctgacaactaacgatgtcgagcatcatttcagaggctaattggccccttgtgcatcgtcttagaagaaatatccatctgagtcctttgttcctggttgaaccaggttagttcatgttgttgattttgggaggttctttatatattgtggctattaaccctttatcaaacgctaacttatgaaggactttatttcactcttgaagtcgtgttttcttggttaagctacaaaaatacgccgccaggcctgactccccaaagcccggaccctcagcatccctctggaccgtcagagaaccaagtgccttcattctaaatgtaagcggatttgtaaggagctgctacctggaaaacgccacagacagaccgtgaccaaaggaagcagggaggtgaggcgacctttactgagtcgtccttgagcctggggccccctgtgcaccatcccctttggtggctcaagggagcaggtccaaatcttcctgttttacagggaaaaacacccgatttgaaaaagctaggcctgcagacgcctgtgatcgcggccaccatcatggctcgtcacaggtgaatcagcattcgccatccagagacgcgcggggttcaagtctggagcaaaatctggcgatgggggtggttctccgtgatgggggccgatgggtggttgggtgacgaatttgtggttttgggtttgcagattgaggctccatccaggggattttcaagggtaagtgttgcctcttggtggctgggtccatataaatggtcaatataggggccagcctggtggcgcagttctgctttgacggcccggggttcatcagttcacatcccgggtgcagacatggcaccgcttgtcaagccatgctgtggcagccatcccacatataaagtagaggaagatgggcacacatggtagctcaaggccagtcttcctcagcaaaaaaaaaaaaaaagagctggaatcttggctcggcctgtgatgtgctctggacaagggtctgaacacagatgcgggacaagtaggaagggaagaacatgtccacaccacagccgggactcgactgaggctgctggggccccaaggcccccacggggagaagcccaagtgaaggggatgagagaccccggagacggggcagtgtgtccaccaggtatgggggtgaggccgtccgggtccatcctgccctgagaggtagatggatagatggatggatggatggatggatggatggatgggtggatggatagatggatggatggatggatggatggatggatg

SEQ ID NO: 42 - DNA, 4177 bp, Equus caballus
cggggtgcggcctgaggcaccagacgccccgactctcgcggcccattttcccccagagccggaggccccgttcccagaggctgcagagaccaaagcggcttcgtggatccagaaaatcgtcaggatgctgacagttgttcgctttatccgtttatgtagaatatacggttcgtgcggcgtgagatgcataatatataggagtgtctagaccggggcaaaattgtttaaaattatgtaatatgtgatagtgtataaactacgttgaaatttctaaaattgtacaatatataacagtgtataaaccacgttaacatttttaagcattatataatatgtaactgtatataaaccatgttaaaatttttaagcaatatataatatgtaatagcatataagccatgataaaattgtttaaaattatatatgtgaaagtatataaaccacattaaaatagtttaaagttatataatatgtaatagtatataaaccatgttaatttttaaacattatataatatgtaatagtatataaaccacgttgaaattgtttaaagttatataatatgtgagagtatctaaaccatgttaatttttaaacattatataatatgtaatagtatataaaccatgttaaaatttttaaacattatgtaaaatgtagcagtatataaaccatgttaaaattgtgtaaaattatataatatgtgatagtatgtaagccacgttaaaattgttaaagttatataatatgtaatagtatacaaacgatgttaatttttaaacattatataatacataatagtatataaaccatattaaaattctttaaagttatataatatgtaatcgtatataaaccatgttgaaatttttaaacattacccaacatttaataatatataaaccatgttcaaattgtttaaaattatataatatgtgatagtatataaaccacgttaacattgtttaaaattatataatatgtaacaatctataaacctggttaaaatttttaaaattatataatatgtaacagtatataaaccacttcaaacttttaaaattatataatatgtaacagtatataaaccgtgttaaaattgtttaaattatataatatgtgacagtatataaacctcgttcaaatggtcaaacatcgtataaaatgcaacagtgtctggactcggttcaaatgcgatcatcctgtttcagaaatgggggcgtttcctgtgaaaaaatacgcgtttcccggctgtttccgaggcgtttcccctgaactcccaccgtccttgtcgtgacccctgctcggctctcaggacccgacgcgacccagtaacacggttcgctggggtccccccgaggtggagacgccccctgtccggcccggctctgaacgagtgaacgctcctctgaagcggagacgaaccgttttattatcacgctcggcgcgaacccattatcataacatcgaaaagtcaatcaacaaacccccgtcggtcggttcccggtcagagggctccagactcagcatctcctgctgacgttggaaattaacgcctgacggaggactaaaaaataaaaattctcgagggacgaggcgttttctgggtgggggggacccccgaggcccttaatctgtgctgaattatttcaatctcgtcttggggcctccacgtatccgggcgtccgtgtccgggggctgcacgcgggggcctcgctggcgaataacccgctttttctttccgcggaggaggccgtttttgcagcaaagagcgtttgctgggcgcccacggcgggcgagacggaaatctgagcatcccccttccctctgggtttcctttccaggcacgacccaaaccccagaggggccgtcctcaccaacggcttcacaaaacgtcttcacaaacgcccgcaacgccaggcgcgactgcgtcaccgggtcccaactcggagagtccggcaccaaacgccgcgtgcgttgtgcaaggagcgtgccgtgtgcaactgggacgggcgaacaggggtcaccgaggccgggtcacaccgccccccccaagagactgtgagcatttctgcttcatcggctggattgagagggtcttaggggtcaagggggcgtcgcccggccctccggggtcccgaagagcaaagtgttgaaatgcgcgtgttgaaacggagtgaatttaacactgagatcgttggggtgaacggggtgttctttcaacacagaatcccactcagggcatcagatgttacctcgaggccaatcttcctcagcaaaaaaaaaaaaaaagggaccataacaaatgttggagagtttgtagagaaattggaacccccgagtcctaaccctctttgcacacgctctttaggactcttccttcagcccgacgacgtcgacggggtcacgcaggggttatccagacagcatgctttgcctttttcgttcttttttcatgttgtttcatcgagttgtttttttttttttcactttaggaacatgtgttcgcccagctgtgcacaagcctttgacccccaaggggatggatgaaccgtgcacggggtctaaagctgggggatggggttaggggggaaaaaacgcaaaaatagggccctggcaacatggtttgaataaaagaggaggcggaagggactgaggacggtgagaaacgcagcccgtggagggtctcccaggacgcgcgggaacattcaggggggagaaacgatcagcgttttttgcgcgttttcatttgaattttcccttctgaacggggtcccggggtcaggcgaacacgttccagggtgaggtttgcatgcactcgatttcccccccccgagaaagcttcatctggctgcaattgacttgtcgctccgccggccctgctggaatcggccctaagaaaaaattagggtgcgtgtggggggtggtgggggggtcatgcccgtcaaagaaaccgtgtgcgcctctcacttctgaggggagagggggactgctctctctcgggccgttaagggggctctctgcctcagtttaccttttaggatccgtcaataacggcctcttgagggccaggcacccgtgtggggcgtctgtgggggaggaggtactgagaacagcacccaaagtgagggatggaaggtgggccgaggagagggaggagcgagttgggggtcaacggcacctgtcactcaatcccccagaagccccggggctggaatggctcatggggaccccaggttggggccgagagtgggcctgagcgttgggaaggaagcctcgttcatcgcagggtgatttctggggtcgggggaccaagcagtgagcccccagctgccagtaggtccagaaagtggggggacgagtggcttgaccctgaacttggggttgcacagtgagcaacctgggcaaccgctccgtccacgctttgccaggacccagggcttccaggacaaagttcacacccatctaccttttccagagcttttccccggatgtggcctggaacacaccccttcgcgactggggtccgtgagcctatagggtctaagggtggcggctgcaaaaagggccccggatgctgcgtctcgggctggtcgtcaaccttgccttccgctcagttgctattttttctaattctcctccgcatccttcatcttttttttttctccgtggaaggcgatgtgcgctttgcgggtagagacgacaccggcttaatttcgggctgcgatccggacctctcccatgaccctgctcgcagcaggttcgtcctgggtccccaggcagatgaattttctgaaatacggaaagcgcacgtggcaacctcggacgagcacttacggtgcagccgttaatcagtgcatttatttatttatttatttatgtttaaaaaaatttttttgaggaagattggccatgagctaacacctgttgccaatcctcctctgtttttttttttttttttttgctgaggaagactggccctgagctaacacctgttgccaatcctcctcttttttttttttttttttttgctgaggaagactggccctgagctaacatccgtgcccatcttcctctactttacacgtgggacgcctaccacagcatggcttttgccaaagcgttgccctgtccacacccgggatcacgaacctgcgaacccccaggccgcctaagt

SEQ ID NO: 43 - DNA, 2835 bp, Equus caballus
tggggctggaatgcaggccttatcagggacttaggtccagggcgcctggaacaaatcctgcaaactgggtagtttgaacccaggggtccacctccccgtcctggagcccggagtctggggtcaagggtcgcagggccgtgctccctccggaggctccaggggagggtccctcctgcctcttccagcgtccggggctccagggtccccgggctggtggccgcctccctcccgtctctgcctccgtcctcacggggctgctcctctgcgtctgcgtctcctcttctgtctctgatgaggacgctgtccttggattcagggccgcctcctccaggaagccctcctctccatccttggattcagggccgcctcctccaggaagccctcctctccatccttgattcagggccacctcctccaggacgccctcctgtccatccttgattcagggccacctcctccaggaagccctcctctccaaccttcccttcatcacacctgcaaagaccctgcttccaaataaggtcccgtgcaagggccctggggtcgggacatgaatggcaggtgcacgctgtgcagggcttgaggccacacgggtccccaagatcgcatcccctacaacacgcttccttcctccccttttccgtgcggccgtagccccgtttatgatgagtcaggagaatcgtgccccaacgtcacaaaacgactgcggcggctccggcgagagcggaggaaatgggaaacaggtgcgtgcgattagggcccactcctcaattaccgtccccgccacgggctctccatccagacccgggatttgcgaggcagcctggaagcgggagtgggggggctgggggggtgcaatttaaggacaaaacagagccctgctttgtgagcctgaggggcccaggggagggaggggatcccgagctctgggccccctggaagctctggatgcacggggtgcaggggcaaagctggcgtctgacattatgccacctctcagatggagcatctacaccctatgggtctacacgggtgacccccgggcacgcagagaagggacaggctggagggaccagcgagaagcatctgcagctgggagcgagggcaaaggaggggggacccgacggagagcgaggacttggtgatttcagcacatggggtggaaactgggagcggcgagagtcaatcaagcaccctccccgtctttgggactagggtgctcgggatgacccaggtttgcaagtctcagctgctggacgtgcatttaaatcagagacgcagggccggcccggtggcaggcatcctgcatgtaaagtagaggaaggtgggcacggatgtgagctcagggccagtcttcctcagcaaaaaaaagaaaaaaaaaagaaagaaagaaaaagaaaagaggaagactggaaatggatgctagctcagggccagtcttcctcagcaggaaaaaaaaagaaagaaagaaaagaggaagattggaaatggatgttagctcatggccagtcttcctcagcaaaaaaaaaaaaaaaaaaaagaggaagatgggcatggatgtgagttcagggccagttttcctcagcaaaaaaaaaaagaaagaaagaaagaaaaagaagaggatacgcagcacttagctcagggctaatcttccccaaaaaacaaaaaacaaaaaaagaaaaagaaaagaaaaagaagaaaaatcatcttttgtgcccccagaaaagctcccggcaagatccgctggtttccagcatccgggcatcaagacccgagtcgggatccgtccttgcagcaggattgaaagggacgggctggtctctggggtcaaatttcttgtgggaaatcagcgctccaggaaatgtttgaaatctcccccgaagagttgattgacccacatgcggagcgttccttccccgtgacgtcaagttcctgaagaaacggggaaatcgacccgggaaaacgctctcaatcgggacaattccgtctgtccgtcacccgttaggacgaaaggagaaacccctcgaacacggggcggggggcgcggggtgggctgaaacccacttccgcttggaccgtttttttgtccgttgccaacgtttccacgcgctgagcgttggcacccgcgcaaaccgggttggagacaatgcagttagggttcgtttgatctggtttgaggcgtgttcctaggacccggtggatgaaactcccttgtgttttgtggggccgattaaatagcggctttttccaggagcgtccgtggagggtggtgggcgagtcccgagacacccgcggtctgaacgcccgccgtccgaccatggggttctgggtgcaaacccggtggattctccacgggagcctcctggtgtccaaacggggcgggttcggaccccgcaggggcctcgggtgtcggggagggagcgggtggtgtggacgccgcccccggatctgcagccgtttacggccggggggccgcctcctccctcctgccgcccggcctgcgcgaggaccagcgactgcggcccgggccccgagccgtgtgcaaaccggatgttcaatgcaagcaaacgtgcggttgtcgcccgtccacgcagccatctgtttgtacatctacctaccaaaccgtcggtctttctatccgccacccatccatccattatccatctaatcacccatccactaatcgatcccaccacttatcatccattctcttaatcgaaccatccacctatccatcaaataaaccatccacttatgcgtggggtggggggggcgatcgagttatcgttccttcttggattatattacccacgcattcgtataagataacgatcc

SEQ ID NO: 44 - DNA, 7114 bp, Equus caballus
cctctaatcaatgggaggtgtggtggagcactctatctctcagttgattggaccgactgcattttgatcaaacgaggttagttgggccttcttctaatcagttgagggccctggatcggaacccaccaggcggaaggaaaaggaggactgtttttttttgctcgaaccgggaacgtccgtcttcttctggcccacccctcactgccccctgcccccccccactcgccgcccccccgcccccaccccgggctttgggacttggaccgaatttccaggcccggggtgccctgggtctgcacgctggtgcagagggtggaacggtgctcgtcgtcgtgcgagcccgttcctaggaaacgtcctccgactgtgttttcctgtgaagaacccggactcggagcgtggacgtctgaagaatctcaacgaccgggcgctgccgcctccgtgttaacattccgggtgcgtgtcccgaggacgagggatccagccagacgggatcgtgctcctacgaggggcgccccgacccccggcggcctggacgagggggctccttagggctaagagctgtcctctgcgacctgaggggtcacgacctattcacctgccggggatttctggggtgccgccagtggatgacgtcacgacgcccccatttcgattgccctttgattgactttttgagcacaagtcccactttttgcacaaagcccgtcaattattattattcttttttatttttttgcccccgttctttttctaagcaggcggcctatacggtggggccgtgtgcaaaacatgcccttttcattgacagagaaaaaaaaaaaaaaagagccaccatcaggatccgcggatcgttgactccatttaagcttcttcgtctgcaaactcggctgcaaatctattctattcagatgtgtctgcgtgtggtttttttcttctttttttttttccccctcctcctcctcctcctccgcgcaccccccgaaacaccgacaggaaaaatgaagccagatgaaaatgaagcctcgtgcatgaaatattttcgccccgtgcagccgggatccgggtcctgagctccccgcccggcctcctggcggcataatgagcgcgcggtgggggcctcatccgtcctcacattatttctctctctctttttttttttttttttttttgcagcaaatgcatgtccagcgtccatcagccgttggaattaaacgtttcgtcacggggcgttctcatctttttttttttttttgcaccacggggcccgagcaaacgacggcgggacattcatttccctgcaaaaaaaaaaaaaaaaaaaaaaaaaaacgcccagcgtttccgttggaaatgaaaatgcagccgcctgagaagaacatttttctcattcttggaagaggcgggaatggggagccatcgatcaagcggctcccggcgtccgcatttttctcagagcgtctgcaagaaatgagccttttggacttgcaaacttttcttttttttttttttcctgtatctattttttggggttttttttgttgttgttgttgtttgagtattattattttttttcctgcattgaaactgggcggatgcagaaccccaccccccacccccaaaataattccggcggcgtcgtcaccttaattaactttaacctgcactataaatattaggatggctgacaaggccgcgagcgtttgctcccgcttttgtcccttaaacaatgccagctctgggctcggctccgatttggacttgattagttggaaatcgcctggaaacattttgaattaaattaaaatagcaactgtcacttcctcttcatggattgctgatcgcattccgacttgtaggttttttttttttttcctccattcccccgccgccccgaataaattagaggagtcgttggcgttgtcaatacaaaaaaaaatttaaaaaaaatggtatcaagaaatgaagagcggggtgaaaataatttaccgttttgggtttaattttagaaactaaagggagaggagagtgacaagcagctgctgcacgtgtttctctcttgtgatgggcgctgtgcgaatacgagcctgggcgtgcgtgtgcgggaccgggtggatgtgggcgtgtgtagacgtgcatggaggggtgcgaacacgcctgggtgtgagcgtgagggcgtgcgtgcgtgtgacttcgtggatgtgtgtgtatgtgggtgtgggaacatgcacctatgtgagtctgcggacatgcatgcatgtgggcgtgcatatatgtgagtctgcggacatgcatgcatgtgggtgtgcatatgtgtgtgaacacgcatgtgtgtgcatgcatgcgtgtgcacgtgcatgcatgtgcatgtagggatgtgcatgtgtgtggacatatgagcacgcttttatgtgaaggtgtgggcatgcatgtatgtgtgtgcctactgtgggtgcaaggacatccatgtgtgtggatgtgcatatatgtgagtgtgtggacatgcaggtacgcgaatgtgtagacgtgcatctatgcaagtgtgtgtgcacatgcatgcacgtgagtgtgcgggcatgcatgagtgtgtgcatgcacgcacgtggatgtgcatatatgtggctgtatgagcatgcatgcacgtggatgtgcacatgtgtgtgtgaacatgcgtgtatgtgaatgtgtgggcgtgcatctatgcaagtgtgtgtgcacatgcatgcatgtgagtgtgtgtgcatgcatgcacgtgggtgtgcatatatgtggctgtatgagcatgcatacacgtggatgtgcatatatgtgagtgtgtgagcatgcatttatgcaagtgtgtgtgcacatgcatgcacgtgagtgtgcgggcatgcgtgtgtgtgcatgcatgcacgtggatgtgcatatatgtgagtgtgtgagcatgcatttatgcaagtgtgtgcacatgcatgcacgtggatgtgcatatatgtggattgtgaacacgcttgtacgtggctgtgcatatacgcgtgtgcacatgcctgtccgtgagcgtgtgcatttgcggcgtgtgtgcatcgggaaggagctgaggaaaagtgggccaagccgcaccccaggagctccttgcaatgtgtgtgcctcggcctcacatggaggctttgctgcgggcgccgctctgtggggtctacacgggcaaaccctcgtcggggtcccacggcggcctcccagacgcaggggaacacggtttggagggacacacagcaagctcctctgttcagggaggttgaccctcggagccttaattttccgggacaggcggcacttggggagaattcagagatttcgaggagttgggctcctcgccgggtgaatgatcaggctgaccctgtccacaacgggtgagccagtgggtctacactgggtgaacccagcccggacccacaaccaggtgggaaaacgacagcccagtattctgtggctcagcggtaaagttcgtatgttccactttggtggccggggatttgtgggttcggatcccgggtgtggacttggcacgccgtgctgtggtagacatcccacatatagagtagaggaagatgggcacgaatgcgaactcagggccagtcttcctcagcaaaaaaaaaaaaaaaaaaaaaaaaggaggattggcagcagttcgctcagggccaatcttcctcaccgaaaaaaaaaaaaaaagaacccacacccgcgagccttccaaggcccaattccacaggcaaacgtcgagtcctccttaagacggagagccgcgtccagagtcgagcgcaggcctttctttctgaaccgtggagcctccgtaaagtcgcgccgccattcttcctgccttcccgcgtgtcttttttttttttttcctctttttcttcctttgtgggtgtcgtcacacacatcaaccccctttgccgttccgggccccggagtcggggacaggaccgtgaggcgccccaggctgtgtggacggcggggtcgcaggccagcgggttctcccggggggtgcggggtgggggggcgtccagaggcctcgagcccgacacctgtctgcgcgccctcagctccgtgccgccgggttttccaattaggagcagctgacaggtcgtgtcgggcccgcgtgacgggcggtgtggacgggtcgtgtctccaggagtcgagccgcggggacaggagacgggaggccgggctccccccccacccctcgtcttcccagctccctaattgatgaagaaagtgggtcgcccgctcttttttattattttgtctttattttttatttttttttacagaacgggttcgcttttaacgcctcctgaaaaaaaaaaaagacgatttctgcaaatcgggtaattgccggattgactggcctaccttttttttttttttccttcttgagagtctgacctactctcttttttttttttttttttttttccctcctggcttcctttcctggatggaaagacagcgacttcgggaggtgatagacatcacccaattgtgtcagccgcgcgcgtggcattaatgaaacataatggatcttcctggatattaaacagtccacactgggtgggtttttttttttttttttttttgcttttttaatggtcatgaggctgctgggacggcctccaacctcgtccactgatgagggtgggcctcagggggctggtccggagcaaggaggttctgcttccactgcgcacactggttcggtcctgggggtcccagctggaggggggggtccctcctgcctcttccagcgtccggggctccagggtccctgggctggtggccctcctctccatcctggattcagggccgcctcctccaggaagccctcctctccatccttggattcagggccgcctcctccaggaagccctcctctccatcctggattcagggccgcctcctccaggaagccctcctctccatccttggattcagggccgcctcctccaggaagccctcctctccatccttgattcagggccgcctcctccaggaagccctcctctccatccttgattcagggccacctcctccagggagtcctgctgtcgatccttgatttaggcccgcctcctccaggaagccctcctctccatccttcccttcatcacgcctgcaaagacactgcttcccaataaggccccgtgcaggggcctggcctgtgtggaggccgaagtccactggggtgctaggtgggaagtgaagatttttgccggcaccggatcactggctggcccacctggggggctgcgggttagaaagcggggggcgcccagaaggaaaccccagtgctgcttcttttgggcacagagagcattatctggggcccaagtgtccgttgctgggtggatggataaatgcaatgtggtccatgcacacagtggaatactatgcagccctgaacaggagtgaagccctgaaacagctacacgtggatggaccttgaatgcacgacgctcagagacagaagccagacacaaaaagacacacagcatgtgatcccatggataggaaatgtccagaacccagaaatccacagacagaaagtgggttattgacgccaggggctgggggctgggggatggcaagtgactcttgatcggggcaaagtctccttttggggggatgagaatgttctggatccagagagaggcaaatgcgtgaccttgtgaaggcgccaaacaccactgaattgtgtattttaaaacggccggctttgtggggtgtaaattgcatctcaactaaacaaacaggaagggattttggagtccccacagggcaggcggcggcaggggacgggctggggtcacttgtggaagagaaagacttgtctcctgaagaaccgcccgtctgctgggccatcaggaagatggagggacagcccgcaggaacgggaacccgaaaaacgtgctgaccagaacgagctgcgtcttacctggaaggggaaatctgagacagacgggcgcgtcggaaacggcagacgttctcacgcttgaagcgtcctggaatttggagaaaaaggtgtttggaaaaaaaaaaatttgcacgtgaacgttcctagcagtgttgttcacaccagcccggaaaggtgcagacaggtgttatccggctttgggttgagagctgtgcagcctttttgctcccacgaggggggagctgtttgaaaaccctcgttcccgaggagtttagcagaaagatttggggaggggagaaagcaggcacctgtgttcttattaagcaccttgatcaagccgctcctgaagccaacttagtgaactttgcattacagaagccaacgccttcccttttgctttaacccattaaggttgggctgtctctcgggggtgccctaaaaactgatgcccaccccaccagccttgcttttccagactttctcacaccccccaaaaaaataccaatttggggacgcagggcgcacgagggccaatctgtccgccagcccagagaggccgtttgtctccgtttctggtggtgagcccagcaggcgccagctggaaacggggaagatctcagggccgcgtcgtttcatttcattccgtgatctctgccagccgccgggagaagaaaggcccgattcacggggagacggcccggcttggaccccccaccccggcccggatcctcgggaacacccccaaactgcagccgagtctatgttcaacttgcaaaacggcgagtgaaacttggcggcgaggggtcctgggggcgcagccggacgggcgttccgagccgacacctcgtgcgcacgccccggatgcaggccggaccagggggagagggccctgggttccctccacgcccccgtcccgcgagctgcattaattacaagctccatggggccggcccggtggcacagcggttaagtgcgcacattccgctttcgcgtcccgaggttcgcgggttcggatcccgggtgcggacacggcaccgctcatcaagccatgctgtggcaggcgtcccacatagaaagtagaggaacatgggcgcggaagttagttcagagccagtcttcctcagcaaaaaaaaaaaaaaaaaaaaaaaaaagaggaggattgacagc

SEQ ID NO: 45 - DNA, 2662 bp, Equus caballus
ctaaaaaaaaaaaaaaaaaatccagaggatgaatggctgcttattatacgcagcctgcatgcggcttgcaaaaaccctaatgggctcgggtgatgggtttcagatgtggcggggggtgcaggccaatggctggtgtcaccgggttggccaagatttttcctttttttttttttttttcctcccaagaagctggttgcattcatgagggtctgggagcggggcgggtggagctgacctttcccgtctgggacacacgggggcccggccgagcccgagggatggggacccggtggcatctgaaggctctgccaagtcgagtcggattcccagagtgtagacgcggccaccacccgccaccccccaacctccatccctttcagtgggtttttctcaatggccccaaatgggctgtttcataggtgagcccgccggggggcccccggaggaggccggaagcaggagggtggccaagggggggggccaccgaggggaccccaaccccggggggaggcggcggcggtggtgatgacagccccgggtgagcgcggggacgcaggcgcgagtgcgggggtgaccccgaaacggctggaggaagaaattaacggaaggatttaggcggcttacccggcaggcccggcgtcccgtgtccgggtcgacaccccatccataaagggggagattaaatatgggcctttcacgagcggggcctgctgacaaccgtgagggatgggatgtggggacccgggccaggccggcgggggaaacggcggagggaggccgccgtggggagaccacagggcctttgcacgaggaggccccgaacaacgggatgacggccaaggacaaggatggaggtgacagttatcctccatatgcaaacatgcgcacacagggggcgtccccgtcaccccccacccacccccggggccagctgcgtggtccctgcctcgtcctcgtggccccaggacctttgcaggaggaagcacctgtgcggggccgcgtctgcccagctgcgtccccgcctccccgcgcgcggcctctggggtcgcccaggccaacaggtgtttttcctcagaacggggcattcccggggtcccggggtcagaggtcccacgcagcccggcccccctccgcccccggggagcccgccgggctgcaccagctgtttaatattatcagagctcgtcggccgccgcggggatggacggggggggggttgtcggcggggccccaaataaatttcaggggagcgcctttcaaagccgggcctattagggcgtctgcgcaatggacgacccggttcacggtaattcgaggaggcaggcggacccccccccccaccccgtccccgtccccgagccaacacatgccgtcctctctcgcctggccccatgggcggtaatttcggggtctcatttccatttgtgagaaaagatcccctacttccatatggaagcaataaatacgagaaagtcattaaaatttctctaatttaaaaagagggaaaaaaaaaaaaaaaggaaaaaaaaaaagaaaaaaagaaaaaagcccctaatgaagtaatatctttgccagaacaggcagaaatgtaaattagacgttggaaggaaaactattaaatgcgtggcgagctcgctggcctctctcgctcttttttttttttttttttttttttgggcttaaatctaatgaatttatgaattgttggttgttgggtcacagactttgttcatttcctactcgttgggctcggcggggggtttggggttgggggggcgacgcgggacggcgtccctaccccccacccccgccaccccgaggacccgcgaatggggagtccattagcggggtctcgctaatcgcgaccccagtcaccacggcggcggcgggctgggattaagaagcgaggggttgcagagtgactgcgtgatgcccagggtggtggcggcctcagagcagagggaaatgaggaactgagtgcaaatcggattctgccgtccccgcgaggccacctccagccgcccgggggcccgtggggatcggcgaggccctgggtcccggaccagagacgtctgcgcccggcgcccctcgtgcaaccagctggagcgacactgtggggtcggaaggtgtccggtcgtcgtgggggtggcggcgttcaccaccgtgtccccctccgagggcgcccagcaggggtgtcccaagcgcccagagactctgctgacctcccggcgaccaggggagcccagcagcgcagcgggctgggggccgcgggctctggctgccttcgagctcctccagggacccattgcccactcgttgcacggttgacccatcttctagtcactctacagttgacccatcttctagtcactctacagttgacccatcttctagtcactctacagttgacccatcgcccagtcactgcacagttgacccatcgcccactcgttgcacggttgacccatcacctagtcactctacagttgacccatcttctagtcgctctacagttgacccatcgcccagtcactgcacagttgacccatcgcccactcgttgcacggttgacccatcacctagtcactctacagttgacccatcttctagtcgctctacagttgacccatcgcccactcattgcacggttgacccatcacct

SEQ ID NO: 46 - DNA, 3681 bp, Equus caballus
ctctttacacactatgtggacctctgtgcagacaccttcacaggtcgaacctatgcccctgccattgcacccttgaccctttggacagtcccctgaaaagtttaaccattttctagtccatatacagttgaccccacggcccagtccctctaccgttggacccatcacccaggtcaatgcacgggttgccccatcgccaagacgttgcacatgggtcaacagggtcaaagctttcactaaaggttcctcctgaaaataagaaggcactctggtcgtacaaatggccatgggctgaatcatgtcccgacccccaaactcacgtgttggagtcctgaccccaggaccttggcacatgccgggatttggagacgggtctttaaggaggggatggcggtcaaatgaggtcatgggggtgggtcctgatgcaccaggactggggtcctgatgggaagagatgatacacgcacagagggacgaccacgtgaggacacggggagaagacgcgtctacacggcaaggagggaggcctcaggagggaccagccctgcctgcatttggatcccagacgtcccgcctccaggaccatgagtccattgacgtcagtggtgttagccgccccgtgtggggaatttgcggtgacggccccagaaaagccatacaatcctcgtatatcagccattctccttgtcctttgggccttgcaaagtgggttcttcctcctgagctttattttgcgcccccacccccccccgaggacttgaaatgaggatctcaaaggggtccccgtacccccatgttcacatcaccaagatatggaaacaacccaagtgtcgatcgatggacgaacgaaaacagagaatgtgatgcatcggtgcaacggaatattactcagccctgaaaaaggaaattcggccgcacgccggggggggggggtaatgggagcatccgtccagttcttccttgcgatgggtgatcccgagggctgtccggctcgtccctctgcacccggaccgctctgtgacatgtcctctcccgccgtggggcgcgtcatccagcttcgggcaccccggaaaacacgcgggaagccagcttgctgtctggcttttgtgcaaggacgatgcaggttttggccgagcgaggttttccccgtcactctgggctggcgaatgtcaccccgtcccatccgggggacgggaaaaatctaggacccggcggccggtcgggccggtgacgtgtgcaaaggaggccgaggtggaaaaatccaccgcagacggtggtgggttttacgggccgcaccgcagcgggtgtaaatggaaacgcctgggtgggttggtggcaatgaaacggtttatagacccccgggcggctgttccctcttaggcgtcttattaaagtgacggccccgtaaacagagaggttgtaaacctgccggaccccagcaccaattaaaataataaaaagccaggagggagaggggtggagggggcctccgagcgaagcgggtttggcaaaggatcctggaggcccgcggaggggaggggggcccggcccgaacgggatccgccaagaggagggaggaaggagagggagcccaggacggggtgaggaaaaggagggctctggtgtggccttcaaggcctgggtggagacggagatacgggaaagctccggggcggcctgacaatcttgaaatgcagggaactcaatgtctaagtggatgatatggggggcattttgctgacctttcacccctgctggaccgggtccccgagggtcagcgagtgaacttcttgtaatattttttcaatcaacaaaccatgtcttccgtaataagaccaaacacaccccaaagttagctaagctgcttcccctcttcctccattttctgagaccacttgcacgggttgtgcgaatggctgctgtccacagagatttggcagaagtttctccttggaatcaccatcaggttctggtttttgaaatttttttatatttttttttgtaaagaagattggccgtgaggtaacatctgctgtcaaccctcctcctctttttttttttcttttttttttgctgagaaagactggccctgagctaacatctgctgccaatccttccctttttttttttttttttttgctgaggaagagtggccctgagttaacatctgctgtcaatcctcctctctctctctctgtttttttttttttttttttgctgatgaagactggccctgagctcacatccgtgcccatcttcctctactttatacataggactcctaccacagcgtggcatgccaagcggtgccatgcccacacccgggatccaaactggcgaaccctgggccgccgaagtggaatgtgcacacttaaccgctgtgcccccgggccggccccgggtgctggtcttcgagggctcatcttttcttgcaatttccgtctgtaaattttcaggttggggtcggcattttctgcgtcttcctggactgagttggcagagtccgtgtttccaggaaactgcagcgtttgggggacgaaccgtgtaaacgctgctgctttccgcagacgctgaattgctcgctgtcgttcaggtctgagggataattggttttctttacaattctgtttttaacagaaaggtcgttgggttcaagtaccaaatatttgggatttttaaactctcttctactcagttcagaaatctcagtttatatcacgtggatcctggaaaagagacggagttttgtttcgtgtttgaattccttattattattattattattattttttgacgctgtttccgacaagcgttggcagaacgggcgtttttttcgttttatccgcgtgcgcgtccacgttgttcaaattctccgtattactgtatgtttttcacctgctggatccagcggtttctgtcgggggacgtggtatggacccagcacaaatactcacttttttctacactgcacgacggttctgtctacctttcgcttggtctattttcaggccgtgttgtggcgaaatccgtgatgaggggaaggatggagaggagggcttcctggaggaggcggccctgaatcaagggtggagaggagggcttcctagaggaggcggccctgaatcaagggtggagaggagggcttcctggaggaggcggccctgaatccaggatggagaggagggcttcctggaggaggcggccctgaatcaaggatggagaggaaggcttcctggaggaggcggccctgaatcaaggatggagaggagggcttcctggaggaggcggccctgaatcaaggatggagaggagggcttcctagaggaggcggccctgaatccagggacagcgtcgtcctcagagacagaagaggagacccaccctgtgccctgaagacaccggatccgtttctgtaagtgagttgctttgtcttgggattgccttccacggatcccaacacccacccccaacatcttcaggattatcttgagtcaccgctcaagaccgcaaacgggaagacattgtagacaatgagcttatccgttgggtttatgacctgatccatgagggtcaacaacgggcttcattggaactcttgtgcaggaagcatcgccgtgtagaccgtgtgcaaaatggcggccgtagtttgactcctgggggtcagggctgactagaaaagtg

SEQ ID NO: 47 - DNA, 783 bp, Equus caballus
cacgggacgtgtgtggagcccgatgctcctatatggacggtgccatctgagcgcatcctgggcctcgtaggaggcattttgcaaacgtgcattcaagggccggcccctcgggccaatcccgctgggcatgcaatcccttttcttgggggtggaggaagccaggagccccccgacccccgggaagccgtccgggcccgtgacctgaggggtcccgacgtgtagacgtttggatggtgtgcaaaagagagttgggagtctggacggattcacgtccccccgtgtggggtaaactgaggcccccgaggccggatggctcctaacatgacacggttgatggggccgagtcgggggaaccaactgcatgaaggaagacgggattggaggctccctgagttggttgattgcatgcgtgtttgttgagcgactactatgcaacgggcgttgagggaactgtgataaatatacgatccccaaggtgcctaatggggtctcctccgagacgcccgttctcaacccggccacacagtggggatggggctcaggactcgataccccaaatgatggcaccttgtatgttgaatgtgtgaagctcaaggagtccaaaaaaaaaaaaaaaaatggcggacgtaggaaggtccctctgacctttgccccggccttgtcccctggaccaggtggtagaccgtcctgcgagaggtgccctccctgcagccggaggacgggggcatcctcgtgtccaagacggacggacggacaggacgcaaggacacggtgggagatgga

SEQ ID NO: 48 - DNA, 1250 bp, Equus caballus
ccggctgcgctgacaacagcgatgacccgggagataagggcgctaatctccgatttacatgaagagcaaacggagacgcaccgagccggttgtggcaccgcgagaaaacaacaaaaaaaaagccctgcctgactttgcgccaccggctcccaccccctggggggcccgagggggctgctgcgggaggagacacgcaaacggggcgggaacctgccgggggtgggggccgcctctgctgggctcgacttgggggccagagtctccatcctattcccaacagggcccctctcatccccccaggagggcccctctcatccccaggagagcccctctcatccccaggagggcccctctcatccccccaggagggccgctcgcacccccaggttgtcacgaacccccagcctcccccgggcgggctctggatcaggtttgcaacctgaagacgccaaggccagtttctgtcctgcgcatgcgccacacagcgtctgcccccccccccccatcccccgggaaggagagtttgggctcccgggggcagcccgtgcgccctcagaagctcggggtccagcgtgacctcggtgctcctgccgccaggagacggcgtgcagaccccacgcggcgtccacggctcgtggcagccccgaggggaaagcgggtcagccccggtttgagtgacaggcgggggcgaggccttctgggccctgaacgggttcccgggtcctggggcgacgttgctgctgtttcaaagcctcacaagccctcggggcccgccggggcctgggccccagggttgcagagttcgctactgagcccctagtgaccgaaagttcgaattcaggcgggacctcgaggcccggaatgcagcttccggggcctgcaggtcagccagcttcctgcacagagagacccccctcccttctcgatcctgctcagcagcacctgatgccaaacggccctcgtgccaccgagtcagacggagaggtcttggtgtggaacaaggggcttttcgggcgggaagagaggaaacattgagaggaggggcttcctggaggaggcggccctgaatcaaggatggagaggaagggcttcctggaggaggcggcccttggataaaagaaagatgagtgaggatccctctggaggaggcggccctggatccaaaggatggagaaggaaggcttacctggaagagagcgcccctataacacagatgtttatagtaagcgtatcccggcagcgagggtacc

SEQ ID NO: 49 - DNA, 3300 bp, Equus caballus
tcaccaaaaaaaaaaacaaaaaaaatttttttgattaaagaaaaagaggaaacaggaagctgcatcctggtgtctctgctgttaggaccaggatctccagctccgcgtgaaatggggtgggctttcgacccagggaaggggtcgttattggctgtgtccccccaaggcttaggccgtgcacgtaatggaagggacggtgtgcacgctggttgagaaagaaccacacatgacacgtgtgcagagactttccgtgtcagctgggttccgggcagggacaaggtgagctgggacggagggcgtcctcacccggcacccacctccgctgccccataaatcgtcggtgtcccgggaaccgctgttccgcgttatttccgtaaataccgtcacgacacggacatcacaccctttcatatttttgtgaatattacttttgaggtttcgacaccaaacctgcatcaaaagaagccgctttttgaaaagaattccgagcccgccgaggcgcatcctcattgctccagccttcgggtgattgacaccttgtaaacgatcccattggtcccgccttcaggtgattgtcaccttgtcaacgttcccattggtcccgccttcaggtgattgacaccttgtaaacgttcccattggtcccgccttcaggtgattgacactttgtaaacgttcccattggtcccgccttcggatgatggacactttgtaaaccttcccattagtcccgccttctggtgattgacactttgtaagccttcccattagtcccgccctcgggtgattgacactttgtcaaccttcccttggtcccgccttcaagtgattgacactttgtaaaccttcccgttggtcccgcctttggatgacggacactttgtaaaccttcccattgcccccgccttcgggtgattgacactttgtaaaccttcccattggtcccgccttcagatgatggacactttgtaaaccttcccattggtcccgccttcagatgatggacagtttgtaaaccttcccattggtcccgccttcagatgatggacactttgtaaaccttcccattggtcctgccctcgggtgattgacactttgtcaaccttcccttggtcccgccttcaggtgattgacactttgtaaaccttcccattggtcccgccttcagatgatggacactttgtaaaccttcccattggtcccgccctcgggtgattgacactttgtcaaccttcccattggtccctccttcgggtgatggacactttgtaaacgctccccttggtcctgccttagggtgattgacactttgtaaaccttcccattggtcccgccttcggggtgattgacactttgtaaaccttcccattggtccctccttcgggtgatggacactttgtaaacgctccccttggtcctgccttagggtgattgacactttgtaaaccttcccattggtcccgccttcgggtgattgacactttgtaaaccttcccattggtcctgccttagggtgattgacactttgtaaacgctccccttggtcctgccttagggtgattgacactttgtaaaccttcccgttggtcccgccttcggatgatggacacattgtcatcgctcctgctgactctcttgaatatcctcgtattttgtttgcggctggaccaccccgcgccccagtcaggacgtccttgaaagggagggagcgtcctgtcttcctttcatcgtgacacgcccagaaagacagagatttttttctaggctggataaaaaaaaaaaaataggaagttcacagttcattcttttgcatctgcgtttagagtgtttcggaggcaacagtcgtgcaggaaaccctgctggcgtttcgcaacagtgactcagttccaggactccatgcgttcatgctacgttttttattattcattcagcaaagaggtgcatagagtcatgggccacccacacattctggctgttgtggctacaaccgaaatttcccaccgtggtgtgggcgaccagtcaggcgtgaaacaaagtttttaaaagcacatgatttagcagataaaggttttcggagccttggggcgaggtgcagggcctccacacaggggtcagggtgtcaatcaaccagggtcgtgaatggtggtctcctgcaaaagatagaaaggctggggccagctgggtggcggagcagttgagtgcacacgttctgcttcgggggcctggggtttgcgtgttcggatcccgggtgtagacatggcaccgctcagcaagccatgctgtggtggtgtcccacataaaaagtagaggaagatgggcacagatgtgagctcagggtccagtcttcttcagcaaacaaaaaataaaataataataggaggattggcagcagatgtgagctcagggctaatcttcctccaaaaaaaaaaaaaagaaaagaaagcaaaagattgtggtcctgcatacacgcgcacgggtctattattttctttgtatgcacatggtgggggggggcggtttgcacacttcattctgccctattcctggcttcctcgtttcccccttcaaaatatgctgtagagacgtctgtgctgctcctatagacgtaacccgttctttgcaacagttgcattgcgtgcgttgagcggatacaataaaactgttacccctcccttgactagtggacttttaaactgttgccggtgctgtcactgtgacgagcaaagtagcagagagcgactcggaaagcgcaaccttgtggacacacacgcaggtgcatctcgggattcatttaaattgtgagggttttttttcccaaattcggccgtgggaagtttgggcccatttgcggtgtatctgacgatgcagcgatagcttctccacgggatcgctgtcttagtttcatcgaactttgcagcaatttttgttcattctaaaaaatagacattttagagtgtgtatataagggtatgcatatatatgtgtgtaaacatatatcaaatatggataatatctgtgcctcaagagtggctggaaaccacctcactgccccaaaaggcagcctgggggagcccagagaatggaggggccgggtaatcccagagcaatgaggatgcaacaccttgatcaagccacgcctgcaatccgcccaccttgggtgtcacattgttcaatgatgtttgagcctccctaatctatgacggcacgctaacgcctccatgagtccacccctgttctgttcctcagtttccatttgacccctcagtcgcacacttaggcctaggcccaacagaaatgaaa

SEQ ID NO: 50 - DNA, 1024 bp, Equus caballus
ccttgggcttggcctttacccggtgtttattaagaaggccaccacagctgtgtggtttccagtctacaaggagtgcggtgttttcacctccagctatccaacggggcctcctattattcttattaggtgagcaaagattggccctgagctaacaactgttggccaatcttcctgggttttttttttgttttttttttttttttgctgaggaagattgaccctgagctaacaactgttgccaatcttcctgagttttttttgctgaggaagattgaccctgagctaacaactgttgccaatcttcctctttttttttttctttttgctgaggaagattgaccccgagctaacaactgttgccaatcttcctgtttttttttttttttctctccctaacgccgcaggacgtggttgtatatcctacttggaggtcctactgggtgttttatgtgggacgccgcctcagcgtggcctcaagagcagtgccaggtccgcgcccaggatccgaaccggccagccccggggccacctaagcagagtgcacgacctgcagcgctcagccgcggggccggccccgccatggggctcttctgggacgtgagtctggaaggccaggagctcgctgactgcagacgggtttcccaattctccgcgatgagcacaccccacaggaagggggagggaattaaggagaaaaaggaaggttccgggtcgtcgagatgtctgtgccgtgcaatcctcgcgctcactctgacgacggggggcggggggcgggcgggggacagacgggcccagagacaccggccagatgtcggcgcgtcaggaaacacagcccaggagagccggctgacggacgcgggcccggtgctgcgcgctcggggtaagccgatccccttcccttccttccgtggtcttcgccgcggtccgtgctgctggggctggaggcgaggcctccgggcgggtgaggacccgagggtgggccatgcgagcgaccggaggaaggatgctccgtgcaagacggtca

SEQ ID NO: 51 - DNA, 1921 bp, Equus caballus
tggatggatggatggatgtatagacggatggatagatgtgttggatagatggatggaaatttctggaaagatgggtggaaggaaggctggaagaatggaaggagggaggcaggatggagagaaggacacgtggggtccctcctccccgccgccccgaggaaactcccgcccccaggaaagcccggccgcccttagaggcatcgactccctaaaaccaaagaaagtagagaaatcatggtcccgcccctgagggaggaggaagctcagagacgccccgcgctgcatggacgggaatttcgaggatcacaaggaaggaggagggagcgcagaggggcccacggggagaggaggctgcaaacgctcagcgccagaaacccgccagacgagtctccacagaggggcccacaccacccaagaccccgttaggggagcggggtgcaggccccgagaggacaccccaaacccagagccgatctgagcgcctggtgtcctccatctgaagacggcgctgggctcccgtctgtaactttttttgttttttgaaaaaagtctgaatcgagtgtatttttaggatcccaggaacgtggagtggaaagtccggggaattcggggcgcccacttccccttgcacacagtcggccccggggtgagccactcccgtgggtgtggagcgtccagcgtcaccaatgagtcaacgttgacccacaatcgttgagcagagtccacggggtccctgagggtccgcccttggggtcggacggcctgtgggtttggacgaaagggtcacgatgtggatccatcctgataggatcacagagaggtggtcctataaacggagggaccatccgtgggctctgatcctccgtgttggagggtcatggtgtagtctacactcacactgcatggagggtccatccgtgggctctgatcctccgtgttggagggtcatggtgtagtctacactcacactgcatggagggaccatccgtgggctctgatccgccatgttggatggccatggtttgggggtctcccaaccctctgcatggacggacctcacatctgagtgctgtgcttggtgattcagtgccttcgatccagccgttatttctcccagttacagacactgatgaagccaggctgtgtagacaaccaccctcagtgatacagaaggtgacacggaatcatggacgccctggatcagtaacggcaggcggtgaccccgggctgaccccaggctggtggaccctccccatgaggcccgtcctctgttttttccccacaccgtccgcccggggaaacaccaccggtccccacgccatggggcccctggcgccggccattgtgctgtccgtgctgctggacccggccttcctcttgacgcgggagctgcagggtgagtgacctgaaggtcgtgaccccttcatgccaactccctggtgccctcgtgggtgtggttcagggtcgggtgttagggagccatccccggggtcgggggtcgggggtcgtgacatgaccctttgagaacggccgggacgccctttgctctggtgagtttggactcacctcgggagggcagacacgtcttggcttcactgggtgagactggagagtggggaacagagaggtcaagcaaactgccagaggccacacagccggtccgtctcggaagtggattgggatccgcgagcaggacgagcccccaggggtaggagggaggggggtccagaaatccaggaggcacctgatttccttttagggcccggggacctggggaacgggtcagagggcggagggcgcggccccgggatcagggtcacgcgagcccagggcggccaggagtgatcatactgatcgatcgctcattttgctcccactacccgctaggaccaagcagagtagggaatagggtgcctctaac

SEQ ID NO: 52 - DNA, 2550 bp, Equus caballus
tcctcttttttttttttttttttgtgctgaggaagactgacactgagctaccatctgctgccaaattgtcctctttttttttttttttttgctgaggaagactggccctgagctaacatccgtgcccatcttcctctactttctatgtgggacacctaccacagcatggcgtgccaagcggggccatgtccacacccgggatccgaaccggcaaaccccgggccaccaaagcagaatgtgcgaacttaaccactgagccaccgggccggcccctggtccaccctggtttggtctctgcgtgttcgcaggtggcgagggcaccgccgcccagaacttctcctgcttcatctacaacgtgcacttcatgaactgcacttgggccccgggccgcgcggcccccgacgacgtccagtatttcctgtatatacgagactccaagtaagcgtggacgggccgtgtagacgaccgtgggggacacgcgaggacggaaaaccgcgtcctgagggttgtctgaactctttggggtcttgcaggaagcgggagagggaatgtccccgttacgtgagcgactcggggacccacgtgggctgccacctcgacgacctctcgggattgacctcttacaattacttcctggtgaacgggaccagccaaacgacggggatccagttcttcgattccgttttgcggtccaagcaaataggtgagaacgaggacccgaggtttcagcactgagtcattcgtcaaacggagtttgcgtgaaatccgtgcaagggtcctggggccactctcaccgatggtcaaaaactgactgcgtgacagtggggagcccagagtctggggtcaaaaggtcgagggaggggctggttgtcggggaaccggctctgggatcgggggggggggttgggtctctgggtttcacctctgacctcggggagggggacagggtggagactgagttcagtccccagaggcccaggatttcctggatcctgactcggtcacggagcctccggaaaaccccaaggacgggggtcgggcagatgtgagttccaaacgctctgtggccgtgagagcgatggcaccgggcccagttgtgtagacgggaaccggctgtgtagacatggctgagaatgccttggggcccggtggctcagtggttaagtgtgcacgttctgctttggctcagggccagtcttcctcagcaaaaaaaaaaaaaaaaaagaggaggattgcagcagatgtgcactcaggccaatcttccacagcaaaaaaaaaaaaaaatcagcctaaagttcacggggcgcggggctgtctttgcagagaggtacagcccgcccgccaacatcagcgtgcagtgtaaaccctcgagctgcctcatccgctgggagaggcccagcgcacacttccgcctggacgaccgcgacttccagtacgagctggtcatccagagacaggtgtgtagacgccaccggcccgcggggagtgaggggggcccggggcccgggaggcgggctcggaagaggcgacgccgtgtggacgaaggcgggtgcgggaggtgtagacagcgtcctcggccagagtaaggaggccaacgacccagccgggctgtgaaagcctgcgggagggtgtagacagctggacgcagctgcggaagaaggaggagcgtgtatgatacggcctcctgggcgcagtgtagacaagatggatcctttgctccatgtcctcctggacccagtgtagacaagggagaggcctcacttcatgtccatctggacccagtgtagacactccctcctgtggccaggttccgatcctgtctacacggtcggctccagggtgagtgtggccaggaggagcccggtcttcactgcccggggctgtatttccctcgacaggcagtgtggacgaaactcgggagaaacccccccaatcgggaaaagtcaaccttctctctctttttttttttttctctcagagccgcacccaaccccctgaatacccgatggtgagttagaactctgaccccgagtgtccgcccggagctggagccggtgttagtcaaacgggcacgcgcaccacggggtggggaaggcgctgaaaaccggggctgggggcgctctcgggttttgtgcagtcaacaacgtgggcgcacgtccatggtctacactgctggggcccgaccttgatccacttgtcacgtcccactgggtgaaatttgtcccgttcctcgtaccccgtggacccgcccgtcctcttcctcttgcgtccgtgtcggcccccaaaatacccctttgagtatcgagattatttcgtccttcaaggcccctcgggtttccagacgggacccccattcggcgccacgagcatgactggggggaaagtggatttggatccttcttccgtgtccgtcgtgccatttattatttttttaaacccacccccaattccgtgtttttctgaacccagaggatcgaggtgccgggcgactcgcagaatcatacattttcccgagtctggagcccagaccgaagcacacggtgaagatca

SEQ ID NO: 53 - DNA, 6908 bp, Equus caballus
cctgagctcacatctgacgccaattctcctttttctttttctttttttttgctgaggaagattggccctgagctcacatctgctgccaatcttcctgttttttgctgaggaagatgacatccaaacggggtctgtttcctcctaacgaggaggggagcaattccaggcacgaaactgcccgggagcatttcaaggtttttagggagcgctgctgggcggtgttttttccctgctccgagatcaatgagtttcgtaacggctggtgtgggatttataggaaacccacggcgagcactgtttcgtgagctgaaacagggacagggtgtgatcgattggccgtcttgccttcggcgctggctttttttcggccaggacgccaaaagcgggaataagccgagaaaaaagacataatctggacttgatcggaatccacagacccgcgcaagacagtggaaaatcgacccgcagagcaggaggaaatgtttgcaggtcgggtgtcggatcagggtcgagtagccaaaatatgtaaagtgctctgagaagtcaatagcaagagtaggaacaacgcaatttagaagtggattttaaaaaaatgaacagacaggggatggccccgtggcagagtagttaaagatcgggacagatgttagctcagggctagtcttcctcagcaaaaaaaaaaaagaagaagaagaagaaagaagattgagaaaagatgttagctcagggctaatcttcctcagcaaaaaaaatttaaaaattaaaaaagaagaggaagagggcaatagatgttagctcagggctagtcttcgtcaggaaaaaaaaaaagggagaaagattgacaaagaagagggcaatagatgttagctcagggctagtcttcgtcaggaaaaaaaaaaagggagaaagattgacaaaagatgttagcttagggctaatcttcttcagcaaaaaataaaatgaaataaaataaagaggaagatgggcacagatgttagctcagggctagtcttcctcagcaaaaaaaaaaaaaaaaaaaggaggaagattgacaaaagttgttagcttagggctcatcttcctcaggaaaaaataaaataaagaggaagatggcaatagatgttagcttggggccaatcttcctcagcaaaagaaaaaaatttaaaaaaagaggaaaatggcaacagacgtcagctcagggctagtcttcctcagcaaaaaaataaaaataaaaaaagcaggaaggttggctcgttatctgtttgtattgaaaaacaatctgccaacaacggccgacacccgatttggtgactgaccatcgtgataaaattgggggttttttttcattggacttttgagcagaaactgataaaaaaaaaaaaaaccacgatattctaaatttctacattatcaattattatagaaaaatcacaggtcaattgtacaaagtgctgatgtgcgatgataagtgaaccccggcggtccgggatccactcacgggcccccccccccgcgtgtccccctgtgtccccaggctccgaggacccggatgcgggggtcgtgcacgtgtacgtgctcatcgtgctggggaccctgggctgcgcgctggcgctcggctgcctggtgaagaggtaaggtggcgcggggtcgcaggccccagtgcgcaggggcggggtacacgggggtgctcactccccatgaggccccttgtggggccaccctagacgctgccagctccccgagcccgtgtggacccgtcttccttcccagacgtccgtcgcgtgcccagctcggcacgagcaaaggccctggggccgccgcacatgcgcgcgcacctttgtaggataatgaatgctcggttccccacgcgcatgcgcggcacactctggcgttccctgcgcactcttccggtccccgcaggttcctccggagacacagtctgttccagccggtcccgcgcatcaaagacaaactgaacgataaccatccgaccgacctccaggtgcgtccaggggtgtgcggggtcagccgggatggacacacgggggggcacagcggccctgggagggtcccgtgaggcccccgtgggtcacccatcacgtccgtctcccctgccccttcgcttccgagctccatcctgccccaggacctttgcacctgctgtgccgtatgccctgcagggaccacaggcgcttcccacaggccatcctgcccatcctgcgggtcaaggtcgcccgtgtagacgtgtccctgatccgtctctacacccccccccgaccccggccagccgtccccccgggtccgacaccctgtcctccttccctcaggacgtctgggaggaattcccggcgggggccggaaaagccgagcacgaagaggtggtgaccgtccaggaggtcgacagagccccggtcagcgggtgaaaggtcacgggcacctccggcccccagacaccccggaagccgcccgggttttctcaaaaccgttttaagcgtttctgcagctatttttctactttttattaaaaaaataaatgtgaagtttggccaagaggcttcccgatggggggccggaaaaaaggcccaaagcttagagatttgaccccaatctatgaggtcagggctgcggaccctcccgctccccgctcttcgagggaccctggtggtggcattggggtcacccgcgtctccagcctcgaacgccgtggatctgtgtaaagcgtctccctgaggtctggcagtcactcacaaacgctcaagcccgaggaggggaggtccagggactggacaggccgaaaggcgcgtcccctctcccttggaaagctgtgccctttggtggccccgacgtggggaaaaacatcctccacacaggaaaaaaaaaaaaaaaaatctggaaataactccaacggcaaacgcgggccccgggccatctcgaggacgttgcgaaattgaggcgttttctttttagggttcccgctttcgcttcccctttccacctcccgggcctctccctccccctctgacccttgacctctgttcaatgcggacgtcccgtcttcacctgggcggatctgctatcagtcattcacactctagtaggaattggttgccttctcttcttaacggtgagcgtccacggtctggtttcccgctcaaggcgtttaaacgcggagggagggggcgctgggggtgattttttcggggggttcggtggacgttttttggtgccccggaaataaccccacgaaaaagaaatttcgggaaatgacacctcctggtctgtccccgtccaacggggcctccaacacgagtcattttcaccgaaatcacaggaatttgttcccgatgaggaggcttgcgccgtgtgcacaggggcgctgggaccacccgggtggcaggggccttaaaacaggaatgacccttgccctcgtcctgggtgcccccccccccagcgggttccggggggctctggggtcagagggcgtgggatggtgtgtcccccaggggagtccagggcaaaggtcgtgacccgcatcccccggggtcagatggacggaggcgcgtcctctggttttggccgcaaaagcgggcggaccgcgtgtccgaacccccacatccggggtcttgggggcccggggagcggacggcgtcccacactgcgttcgcactaccaccaccctgcacggggcggcttctcccagctgcgtccgtgggaccatgcgggggtcacgtgggtccccccaaagccccgtcccctggggtgtccggggaccccagaccggggggcggctgggccccttttgggagcaggtccggccgcctcctccaggaagccctcctctccatccatgattcagggccgcctcctccaggaagccctcctctccatccttgattcagggccgcctcctccaggaagccttcctctccatccttgattcagggccgcctcctccaggaagccctcctgtccatccttgattcagggccgcctcctccaggaagccctcctctccatccatgattcagggccgcctcctccaggaagccctcctctccatccttgattcagggccgcctcctccaggaagccctcctctccatccttgattcagggccgcctcctccaggaagccctcctctccatccttgattcagggccgcctcctccaggaagccttcctctccatcctccccttcatcgcagctgcaaacaccccgtctgcaaataacacgccgatctgaggtcctggggtgacgaggtggacctgacctttgggggggacggggttacaccccaaacagcccccttaggacgagtccctgtcccctcacaccctgcgggagcccctaccccccagccgagccccattctgcctccagactccacctgctcccccgccacccccattccatccacttcctcccggagtcagtcaacaaacatctcttccaccctaagtcagtcaacaaacgttccttcctgaaaaaaaaaaaaaaaccggccaacagacgttttaggctccgagtccacccgtgtccacgcctccatcgcccctccctcggcccggtgacgtcaccccccgcctcgctgggcgtcctggtcccgcaggcgcgccgtgtctggtctttcctataaagggacccacatgtcgggagatctttagggtccgggttgtttgtagccgggtgcctgtgaccttcgaccccgtcctgctgtgggtgggcagctcgggggttttgcgggtcagccgcgtgcagtgcgcggatctacccgtttccgtgtccgtttcccacgtgcacggggcgtttgggggcgtttcccggcccgggcgatgttcacaaagtggctatgcgacattgaggtccgggtgtagacgccgtgaccctccgtgggatggtctcagcggttgggggggggcctatttgggacccacaaacgcgactgagacttaaggggtctccccatctctgcccacaaatttttattttttttcctaaccccccgcccgccccgggttttttttaaaccattgaacgcctccagcaccccgtgaatttccgggtgcctctgtggagtccccaggttcacccatccccagacaacctgatcaattttttttccccccccccgaggaagattggccctgagccaacatctgctgccaattctggttgtttttttttttttttttttgctgaggaagactggccctgaactaacatccgtgcccatcttcctctactttatatgtgggatgtctacacagcatggcgtgccaagcggtgccacgtccacacccggaatctcaaccggcgaaccccaggccgctgaagcagaacatgcgcacttaaccgctgcgcccccgggccggcccgtcctcatcactttttaaagcatcagctaatttatcaaaaatcgtatgttccacattcatatttgccaagggaaaaaaaaaaaaaaaaaaaaaaacctcttttttttttttttgcacgtttgtgagttattttgtgtccgtgtgtacgacgcccgggacatgtctggccccgttcggacgggggttttttttggactcggttctcggggtttttccagatgcttttgtcagttttgacggcacgagtctcacctgcgcggaaacgatgcgaaatcacacgggagacgcggcccctccacggggcttcccacgctcaacaacacggagttcaaacaattagtagatattagaaggatgacagcaaagctgaagaattaatagtcacagaattattatagcaattctgaataattaatactctagaatcattgtaacaattttaaataattgatagttaggatgattataaaattttaaataattaacagttattagaatgattataaaattttaaataatagtcattagaatgattataacaattttaaataattaatagttatgagaatgattataaaattttaaataatagtcattagaatgattataacaattttaaataatagttattagaatgattataaaattttaaataattaatagttattagaatgattataaaattttaaataattaatagttattagaatgattataaaattttaaataattaatagttagaatgattataaaattttaaataattaatagttattagaatgattataaaattttaaataattaatcatgattagagtcgttataaaattttaaataattaatcatgattagagtcgttataacaattttaaataagttatagaatcatcatagcaattttaaataattaatagctattggaagcattgtaacaattttaaataattaataattattagaatgcttataacaattttaaagaattattacaatcaataattttaatgactaataattataattattataataatataaaataactaataattataattattacaataatataaaataaataaaaattgttaagggtcattacaataacgtaaataaataataattatttggattataataaatttaaatagttaagaaatattagaatcattatcctgattttaaataattaataactgtaggaatcattttaagaatattaaataactattattgaaatcattataataactttaaataattaattgttaggatcataacaattttaaatattaataattgcaatcaatattttaataacaaataactattagaatagcttaaaggtgtttaaaaaacaataggcatttaagaatcaaaatgttaaagaagtagaggattgtgagttataggaagttttaactggttaagattggtagtgctgattttagatcggtgaaagcattaggctcgtggagagaaggttacgattaggaagcgaagtaaagggaaccaccgttaaagggataga

SEQ ID NO: 54 - DNA, 8424 bp, Equus caballus
tcatcatatgaattttagttaattaataacgattagaaccgttatactaatttttaaacaattcatagcgattggagtcattcctctaattttcaataaataatacttcttggggccattgttctaatttcagacgattaatagctgttggcgtcatggctctgatggtcaataggtaataaccaggagaagcattgagcgagttttaacccggggattctgcgcgccgggtgggccgcccctaagcagcatccgaacgctcacagttctgcgttttctgcgggtcgttgttccccaaagtgagtttttggggagcttgacgggcggccgggctcggggtcttcacgagccaactcggttttggcgacgcggatcgtccacacggccccacatccccgcccttcttgtcgggtccgagacacgagcgggtttttcctaaggggcccccgtgtcctcgtctccaccgccgccctccgcccctcccgactggctccaaacggccaccgtctctggtttggacaacgaggagcgggggcgggtttcaactctgctttcccctcctccctgcaatcctggcagccgggggggcaccaggaggaggtgacactacattgggggaccccccccgcacccccgaccccaggattccagggttccactcatctcaagaagtgggttggtccccgtgcagccacctccctgggcatccgggtctctgtggtctacacccgcaggatagaatcgtcgaggagcgcaaagacggagccagccaagcgtgtttcctggaacgaggtgctgacggcgccctttctggggaccccgggaaggggggtccccaccccaggagcacagaaagggggtcgggtctgagtcgtggtccggaaagttccggaacgtgcacagcggacccagaccctgggcgccccgagtgttccccgaggggccgggagactctcctgcagaaagcggaaccccgacgtgttgataagaacctgtgggcggggggcgggctccgtggtgtagacggatggctggccgggttcggacacttcctgtctgtagagacgataagggcggaaaggaagagtcaggtgataggaggcggggcgcgtcgggagaggctgacccggagccattcgtgaagggacacagcgagaggagagcgtccacactgcaggcggcgccgacagccttatcagggccttgattccaaaggccggccgcctccaccacggggccaccaccgggcccccctcagcaccagccgggcaggaggacgggtctggacgggtccaagcgacatgcaggaagctggccgaccggtgggttgactcctttctccatctcgggggctgttagtttgcaggaccccgggacggcacaggattgtagatgtggcacccgagtggagcctctgtcctgggaaggcgggtgggtgggtggctgtgggagttcccgagtgcgtaagatggatgaccccccagtccgggctgggatgcgggaaccgatgggcgggtcagcgaggggccccaggaacagtgtggggaaggacaggacgggcgccaatgctttcgagctcaaggccgcggacaaccagcgggagccggttgcctgtcgccctcggcctgaaagtcgagcctgggaatctcccctcccgcgacggaaacgttcgtgcaccacggagccgcccccagagacaactcgtgtctccgtccgagagcctcttatctgcacgacaaggaaacgccgtcagccgcacgtttcctcccttctgcttcccatgactgtccttccgtcaccaaaaagccccaaacccctgttcttcgtggagcctaagacggtgcccgagcctctgtcgtctacgtgccgcctcgacccacctttttctctgtgaacccaggcgggtgtggacggaactaaagctagttttcccgcgaacggcacttttatcggtttaatttgcaggtcccagggacagaatctaagagggtagagggaaaagattttttttttcttccgttgcttacaacgtctgccctctgaccctcactgtccccggcctcctccctcgggccggcctatccaggagggtgtctcgctcgcttcgccggttcccccagatcaggccgtatcgtcgtctctcatcacgtgaggttggcgactgtgtcaaaaaaaaggagagaaacggtcccatcccgggctgggtgcccctcggcctcgctcccagtgacctctgtgcacccagcaaggtcgtccccgtgccgacccgtggggttgcgaagccgttagaagaaactgtgctcaaatgaacccaacgccacccatttctggccaagatggagactccggcggaacattccacacccaagatggcttcagggccacactcgccacccggatggacgcggaggcgggtgacccccctgcgccgtcgctcttcccccgaatgatgccgggcatgtccccacccgcggggaccgttgtgagcgggtggagacggtgcggcgggaagagttgcctcatgtcccaaagcggctgctgtgggccggcgtcttcatcacgcgtcccttattcttttctcggggcttcgcagggcgtttcgagcaggatgtcaaagggtatctggggtcacccggtgaccccacgagtgggagcaggacgggggcctcccaggggacccgcagacccaatggggccgcatggaacccccgccgacccttcaccttttgagggcgttgacccccctgggaagggtggggagccgagaagcgagggcttctggggtggctgcgatgtgacctctgacctggggtgtccccgttcccgtttaggtccagctgtggggctggggcgccgcggccccactggatcccgtcggcctcctggtgctgctgagctgggcgagctgcgggcacccagcgcggggtaagttgaggcaccaaacccgagtggggtgtctgccccgggtgggccccacccaaagcgttttcctaaaattcagattatggggtcacgggggcgcctccccatgcctttgatgggcgcatccctgaggaccaagatgctgagcgtcttcagcgggtggatcccgactctggggaagtaggtttttaaattttttgttgttgttgaggaagattggccctgagtgaactactacctctcttcctttttttttttttttttttttttgctgaggaagactggccctgagctcacatctgtgtccatcttcctctaatttatatgtggggcgggccaagcggtgccatgtccacacccgggatccgaacccaagaacccgggaccaccgaaaagtggattgtgcgaacttaaccgctacgccaccgggcaggcccgattttttttttttttttttaattgcagcacaggagagcgtgtcccccattctgaacatgaagctggattcgaggacgaaaacgctgagctggaattacaggcggaacgtgactgagcaggagtgcaaaatcgacacgccgcccgacgactcgacctccaagaccccgcaggtgaggggtcaggggtcgggcctcacggccttgctccccgagaagcgcgggtgtccctgtgcaatgccgctcacgtctcctcctcggcctggagtcccactcccgtggctgttgtgcgggaggaggaaacacatcctctataatcttaggttcctggatggaggcctgcaacttaaagcgagaaacgacagaggaacgagggaaacgggggaaactgtaaagtccgggtctcgattttaggaaagtggaggcgagacagattttttaaaaaaataacgttgtattcggtttgcgaccgttttcttcaagcaaaaagaggaagattggcaacagatgtcaggtcggggccaatcttcctcaccaaaaaaaaaaaaagattggagcgtattagtattgtttgtgcctgacgacgtgcgccagccccgtgggtcgtcgggagcacctgactgtgtgtttccttctgttttaggaatctctggtcatgggttcccctccttcctcccgttctgggattcgttttgaaggttttctcctggagggggaaaaaaaaaagctggttcttttgacaaggagcagttctaattttttaaatgaagtcagtagcatttttaccctcagtttggtccccgcgaatgtggagggaccttgaacacacgacgctcagagacacacgccggacgcaaaaggacacacagcgtgggattctgttcgtagaaaatgcgcagaatgagcaaatccagacagaaaggggatttatggggccgggtcccccattttggggagacgcttgatgctgggagtggaggaaagggtcccccaatatcctgaatgcgctcaacgccgccacctcgaacgcccagaaaaagtcgaaacggtaaattttacgttacatggattcggccacaaccaaaaaaaaaaaaaaaaattttttttaaaaaccctaaaaacagagacccgtcgatgccgccgtgtttgcgtcgatcaatcgatcgaagtgtcccatcaaccgagtcatgtcccacccgagcggaggacaaagaagatgttgatcatcaccaggcaggggagcgggatgcgagggccggtgccgcgcagccactgggaggtgcagaggcaggaagaatctcactgtctatacagccgggcagggccgactccgcacacacgtttttctccagaagaaaaattaaggttttttcccgtctttgcgacaagtggggggggccttaactcttggggcaaaattcccgggacgccaaacctgcgggaggccccctattttttgggggggacacttgtaggggctggaatgtcactaaagacagacgctgccgccaccccgaaatccacgccctcacaaagagaaagaaaaccggattattcacaaaggaacgtgaaatttgtggaaattcacccaatgacccccaaaaagaggacgaacggggccgtttcttcggagcggggtctacacggaggtcgggctgtgcgcgtggcagagcctcagagtcccgcagaggagtcggggagcctcacatccgcgtgagggaggaaaaatccttcctgtacactgttaggttcttgcaagggggaatgctaattaaactggtgggagacaggaactggaggaaagctggctgaattttaataatcatcatcttattttctgtaataattttattaataataatctcatgctgcgtcctcggcggggacccccgcgtggggccgtcacggggtcccaggggtcccgttcttaacggcgcccgttccaggtcaatgggaacgacacctacttctgcgagttccccaactcggtgctgcaccggggggccaacctgacgctcaacgtcaactccgagggggccgcgttccaggaagtcctggttttccacaactcaggtgacgtccccaaccccgtccgcaccccgacctccatccagcgtcgcccgccgtccccggggctggggttgggtgtggtgtgggtgcagcgggtgtagactggcgctgtctccccaggcccggaaggttccggggccgtgaacttctcctgctttatctacgacctccgcttcctcaactgcagctggagccccggcccggccgccccgcccgacgtccggtatcacctctactggtgggcgtccaggtgagtcccaaaaaaaccgggtttttttatttttttttttggagagggttttgggggtcgcgtttcccgacgggatcgccccaacgggggtccgcgctccgggttgaccccgtattggggatgttccagtcacgacccggaggtcgagtgcgcccgctacgtcgtggaccccgcggggacgcgcgtgggctgccacctggacgacctcggggaccccaagacgaccgactacttcttcctggtcaacggcaccagcaaccgcaccgccgtccgcttcctggacttcacgccgtttcgggccaagctgatgggtgagaggaccgggcgccttccgcgtcctcccaacacccaccccgagacgcgggatccgcatgtgaggtctggggaaacacgcacgcggcagcctttttgtgctcggggaacggaacagacgaacaaactttgcctccaacctcttaagtccggtgacggaggcgtgcaaattaaacttgcaactgctagataaacggcaaatgcatgcacattttactcttaattggactcctctgcgaggcacacgggtaactcgttgcctcgtttccatttttttttttttttcctagagaagtatcggccgcctgccaacgtcaccaccgccttcaatggctcccaccacgtcgtccgctgggacgaccccgagacccggtttgacgtcgcgagtcatatgctgtgctaccaactggacatccgacgacaggtctggaccccgaacctcggccccgggcccgacccgagtccctcacacaggggaggaaaactcacaggaagggaatttcctgttgagggagaaaaaaatcctttcttccaccctgttatgttctttcctgagggtctgcaaattaaatcaacaaacgacagcttaacaggagagaaaaagcaaaatttactcattttcatgtgggatttgacaacggaagtgactccctaaacagctgacgttagaggcttatccgcctaaatgaacaggggacggggaagggcggggaaaaggcttctatgggaagagcaaatggattttttgggggaaagacacaatttccgggcaatttgctctcagcctccttcctgggagcccagtctccccgaggagggaattctcggcgctcctccttcccgccatttctttgattttagggaaccttccagaagcttctttgtgcgtctgtggggtccccgaaatcttcagcttaaaaataacccccgtagccattctggggtccccctatttgcctataacgccacaaacgccgccccttaactgtgttccctttgctgtttttctcacagggcagctcctacaagagagaccccgtgagtactcctgcctgtgtctctgtgcttgggccccacgctcacccctgaccccactcacccctgaccccgcagcggctcagctgacgggtcccgtcgagccccttacgggctttttctggggtcccgaagctgcgtttccttgaaggcgtctgcctcaggtcgcgtagtcggtcatcatacctcccgcagtcggagcaacatccttcttcccggggccgcccctgggccccttaaggagtcgaatggggtccccccgaaaactcgtgtccgcccggaaccccagaacggggccgtctttgggacgtagggtctttgcaggtgtaggatgttgagctgaggtcttcctggaggggggggcggtaaactgtaaagtcctggtctcgattttaggaaagtggaggcgacctagatgttttatgaaataacggtggattcggtttctgaccgttttcttccggcagaaaggggcagatgggccacagatgttaactcgaggccaatcttcctcagcaaaaaaaaaaaaaaaaaaaaaaaaatgggagcgtcttagtattgtctgcgcctgacgacttggggcgccccgtcggctcccgttgggtccccccaggttttccaacggggtagtgacgggaatcagtacgtgctgcccggctctgcggtgacggcgggggacacggtgcgggcgcgggtgaagcacgtgtacggcgacatctggagcgcgtggagccgggccgtggacttcagtgagtcccctgaaccccactgtcccacccgccccttttgtccctggattcagggccgcctcctccaggaagccctcctctccatccttgattcagggccgcctcctccaggaagccctcctctccatccttgattcagggccgcctcctccaggaagccctcctctccatccttgattcaggggcgcctcctccagggaggcctcctctccatcctggattcagggcggcctcctccaggaagccctccctctccatccttgattcaggggcgcctcctccagaagcgcgtcctctccatccttgattcagggccggctcctccaggaaggcgtccctctccattcttgattcgaggcccgcctcctccaggaaagccttcctctccatccttggatcagggcgcggctcctcagagagaccctcctcttccatccttgatatcagggcgccctcctccgggaaagccgtctctctccatctttcccggagtccaatcccaaaaaaaacttaccaaacacccgcctttcccctgaaagaccacatgaacgaaccggctactccccccgagtctgggcggtttgagtcgcaagtgtcctcaaaaagagatgcccccgaaagacaaaactcttctcgaggacttccctacaga

SEQ ID NO: 55 - DNA, 8711 bp, Equus caballus
gatcatagtagccattgttatatgttatggagtaatactccggatgacactggtagtagccctcggctagcccaggtctacacaggcgtttcttctgtatatttttcacggaaggcactcggtgtactcgcgaccacacaggtccggggtgagctgcgggggcacggggggagccccccccaacacacacacacccgcctcgggttccagccggccttgcgcgccgaccccagagacgctggggcgaacgaggatgctgccttctcgggaaacggaggcaccggggtggagcctcgctgcaggctgggggcgttggggtcacggggtggagcctgaaaatgcgtttttaccgttttttaatttttttttttttttgaggaagattggccctgagctaactactgccaagcctcctctttttttttttttttttttttttttgctgaggaagactggccctgagctcacatccatgcccatcttcctctactttctatgtgggactctgaccaccacgtggcttgctgagcggggccatgtccacacccgggatctcaaccagcccgggggctgggaccccaggtgggtggttctggaagcccgaatgggactcagacggccgcgaagggcttatcaaggcggagatcccacccggcggcaatatgcacgcgggcccaaaggtggacaccgccgtcgggggctggatgcgtagacggaatgcggtgcagccacgcggtggaatattacgcagccgtgaacgggagcgaggccctgacacagctgcgcgtggacggaccctgaacgcacgacgctcagagacggaagcacacgcagaaggatgcacagcgcgggatcccgttgaggggaaatgtccagagccggcaaaccccacgacagaaagcggattcgtggacggggacggggacggggagcgactgctggtggggacgggcgctccgtttgggggggtgagaatgttctggaatcggatgggggtgaacacggtgaatgccgctgggcgagctggggagccccgggcctgggcgtgggggcagctgagacccccccctttccgatggagcctgtgttgggtgcggtgacggggggctgcgaacgccctgagggaggtcgggagagtctgtgacccctcctcaaccccgaggctcggctgtggggtcgtctgcttgtgtggcagccccgggcgggcccccaaggcactgacgacgtgtgcaaaatgagactcggggtggggaggagcggggggtccgtcaggaggtgtgtggacccccccgccgagtcggggtccgaggagtgcacagcgagctccctgggggccatgggaaaaacttccggccgggcgtgtggggcggcgttgggttcccggaacgcggccgggtcaggaaacgggcggcgctgcggtcagacgttaatgggacttcctgcccggctccaggacccggcgccgcctgggtcggggcgggttttgccgggtgtggacgagcgcggggccgagggccggctcttaacccccgggcgggggccttcgagacagggggacggacacacacgcgtgcacacacagagagagacgggcacgtgtgcacacaggcacacgcgtgtgcaaaagaagcatgagcatgcacacataggcatacacacggaggcacatatatgcacacacacgcatgtgcatgcacacttatatgcacacatgtgcacacacacggacacgcatgcacacgcgtgtgcacacgcacgggagggccaggaacgatgcgcccacgctcactccgccttctcttccagcgcacacgcccgcccgccggccccatggccttcgtctggatcacgctgttcctgacccccacctccggcctgctgcgcccggaccagggtaggcccccgggacggccgtctgtccatccgtccgtccgtcctccgtctgagggtctgtgggggggggggctcttctccagttaccctgtttcttctgattccgaagtggagctggtctagatgcccctgtcctgatggagctctgggcacgatggtcgattgcttccctctgcccaggatttctttttttcttgaggaagattggccctgagctaactgcggccaatcctctttttttttttttttgctgaggaagattggccctgagctaactactgccaatcctccttttctttctttcttttttgctgaggaagactggccctcagctaacatccatgccgatcttcgtctactttatatgtgggacactcaccacagcatggcttgtcaagcggggccatgtccacaccagggatccaaaccatctgtgctgggaaacggggctccagccataagccggggcgtccaggtcactcacctgccaaaactggggcgtctttgcatgaccgttccaagctcctgggcatctttgcccgtcttggtctccccgggggggccctgtgtctgcgtctgtctctgaggaggacgctgtccttggattcagggccgcctcctccaggaagccctcctctccatccttgattcagggccgcctcctccaggaagccctcctctccatccttgattcagggccgcctcctccaggaagcgctcctctccatccttcccttcatcacagctgcaaagaccctgtttgccaataaggccccgtgcaagggtcctgggttcagggctgaatttggggggcccgcgattcggcccctcacagggctgaattcgaggggacggccccggggtcctggcatcgtgacctctgacctccctggaggagtgtgtggacaccatgcaggactttttacggggcagacggggtcccgtttcgttgggtagatgccagtcccggggtgacaccccacgccgacctcggggccggtctggggccgagaccgcggcctcctctgtggtcacttcaggccgctgggttttctgggatcattgaccacaggcaggaagcgaattgttcgagtcctaaggagaagtggttagtcctccacactcgagtatgaattagctccacggttttcacagctggcttttcgttagcgtgacgcgttttttttccgttcccacagagttttgaaccccggatgccaattttatttcttgctggattttcgcggctgatatttggggaaggaatttcgtgtctgtgttcatgaggcctcgcgttttcttcgaacgtctctgtctgattttggcgtcgggagaatgcgccggtcccataaaatgagtccgaagacgtttccttttctgctctgtctcgtctttcattcctaaaattcctcattttatttcccctctttttttgaggtttttccaattatcttgttttttgcatagaaacagctttgggttttcttggctgtccgtgtactttttgaaatgattaaagattttaatgaattctccgtggacaactgataaaaatacgaattctgctattattgactagctggtagttttttatcaacttttctctggttttactgttttctctacttgtttcctcaattcaagagggagtttgtgcttatgcctcatgcgttttgaaactttgttcctgggagcacagatgtgaggatgaaagggccattttatcctgtggaaatttctctttttataccagaaaccgtccttgtcctgcagtctacgtggtcttacattaatgtagcattttcgggtttcgcatgattagagtttctgcaaaatacacttttctagtattttcattgacatttaatttgaatgtatgattaaatgtatacatttaataaatttaatttattaaatttattttaataattttctattacttaaagtaaataattaaataatttaattattcaatttaaatattataatttctattacatttaatttaaattattacatttgatatgaaatttaatattttaatttggtattattttaacttatttaattaaatcgtctaatattattttaatttatttacattctaatttgaaaataaatttatttaaattgaattgaatttaaaattgaaatttcaattttaataatttgatttaaaattaattgttttaattaaaaaattcattattttaatttacactatttaatttaaatgatagaaaataactaatacataataatatctattatttaaatttacactttaatttaatgtaaattaaaggcatttaaagtaccttccttgtagacagcacactgtggggggggtttttttttaatcgagtctgacaaccttttctttccattgggccgtttagacccttcacacgtcatgtaattatcaatacagttgggtttaattctaccattttgctacttgtttgctattttcctcagtttttctttgttcttttcccctcttttcctggcacctgttcccttaattcttttttagtgttccgttgtttttcctccattggcttttcgtctctacctcgctatcgatttcgggttcctccggattttaaatatccgcccttcgtcgatcacgtaccatcttccaatatcactctacttcgcccaggacggaggagccttgaaacagaatacttttatttctcccctcgtccttcacgctgtcacacctttcacgtctacccattttataaagcccaccctgcactgggcttgtttttattttaaacaatcacatttttacatatttactatttacatatttatacaccattcacacattcacgtgctgtttgcatatttacatgctatttgcatatccgcgtgctatttgcatattcacatactactcacatgtttgcgtgctattcgcacattcgatacgtctgcatatcatttgcatatttatacagtttgcatattcacgagctatttgcatatttacatgctatttgcatttccgcgcactattcgcaggttcacatgctattcgcgcattcaaaaccgtttgcacaacatttgcatatttgcatgcggtttgcatattcacgtgctatttgcatgttcccgtatatttgcatattcgcatgctatttgcgtgtctgcatacatttggggacactcgctgtggatccctgttccccctttcctcccgtgtttcttggtgtagacctgagtttccatctggggttcttttccttcaggaggaagagcgtccttcaacctttctccagaaccccggtctttcggggaaagaatcctttcagtttttgccagtctgaaaaacggcttcctttcaccttccttttcttgcaaaacacaggattctgtgtcaacaggggctttctgcggcggtggtttttccttccgcatttcgggatggcgttctcttatcttgtgtcttccatcgatggtagcgagaaatcagcggaaattcttatctttgttttttttttgttaataggtattgtgttttttcccccccctctggttgttttgcagaatttcttgatgccacttttttttttttttaagcagttgggttgcggggtctcctggtcggttggcttcatatttttttctttggggcttcagcgtgcacccctccgattgcatttccttcaagtcctccgaccttttcttcgccacctgcttggaagcccgtgcgctgcattttttttgcatttcagacgttctctgtcctacaagtcccgtttggctcttttttttaaaaaaaaaaaaccgcatcttccatccctccctgtgcggtgtggaccgtcccctttaagtcctggaacatatttctagcggctcttttaaggtccttgtcagttccttgcacgcctgtcgtttatgaggctgtttgcacgcacgggcatctcgccctggtcgccgggaagcgcgtccccgcatctctgcccggctgggaattttttatggggtcccaggtattggagacgacgggctggtgggggtctggcctttcgtgttcctttaaaaagactcggcgttgagtgttttccggctgttccttggtgggtgggtcgtccctcagcaggtgccggacgggaaacgctcctgggagggacgcttggcagcgcggctggtgggggagacgggaatccgaggcccgacccttgacctccgacctcgaggggatttcctaccgtttggggttttgggaaagtgccccaaagtggaggacgccgcctccgggaaggaggcgggcattgctcacgcacggcagggaacaatgtcctgcgtgtttgcattggttttgttgtatttgtcgtccagattttcctggtctttttctttttttggcatgagagttttttctttgtgagcagaaccataatcgggtggagaataagcaagtgtaagagcgcgcgtggacgttattgattaattcatgacagaagatgccatggttatgtccttttatggcatatatatgtgtacatacacacatacatatacattccttatttgtataaatacaacatttagaaaaataaaatataattatattataattatataaatgactataattcttcactattagtataaatatagtatttagaaaactaaactgaaatataattattcgtatattatataaactaatgtataattattcactattagcatatagtacttagaaaagtaaactaaaatataattatagtataattatataaacgaatatataattattcactatttgtataaataaagtagaaaaactaaaatataagtattttataattatgttaatatgtaattattcattatttgtctaaatacagtgtttggaaaaataaactaaaagataattattttataattatgtaaactaatatataattatccactatttgtatacatacagtatttagaaaactaaactaaaatataatttattataattatataaactataattatataattataattattcactatttattcaaaatttgcataaacatagtatttaggaaaaaactaaaatataattataattatataaactaatatataattattcactatttttctaaatatagtatttagaaaaataaactaaaatataattgcattataattatataaactattatgtaattataattattcactaattattcactatataattattcactatttgcataaatatagtatttagaaaaataaactaaaatataattatattataattatataaactaatatataattattcactatttggataaataaagtagaaaacctaaaatataagtattttgtaattatgttaactaatatgtaattattcagtatttgtataaatagagtatttagaaaaataaactcaaatataataaaaatatgctaagactcgtatttactactccaccactcacgcactgtttatttgggcagaagtgaatgtaaattttgaggcataacaatccattcaaaattacgggttcagctcataagaaatttccgtggatgagctttttagaggaagaggtgaggttcagagaaagttttggcagaaacccagatggtcgtccgggtgggtgtcgcttgtgcaacgcgagttatcgatcttgatgccccaacagggaacttgcatttcacgaacttggacaaaaaagtttatcaacagtcatttcctcgaagtccccaaaacgtagggtcacagataaaatctgacaaagcatctcatgtccctttgtagcttttttttttctgttttgaggaagactggccctgagccaacatctgctgccaatcctcctctttttttttttttttttttgctgaggaagattagccctgagctaccatctgttgccaatcctcctttttttttttttttttttttgctgaggaagactggccctgagctaacatctgccaccaatcttcccggccccgttttttttttttttttttgctggccgcccctggtccacgtagattccacttcccaacgagatcagccaactcgggggggagaaacacgttcccatctcgaggctggttcaagcgtcttgcgtgtctctccccgaccgtaacccgtgaacgtttcagatccgagcccgccgattcggaatgtgaggatggagccggaaagtcagagactgacctgggacctccacggaaatgtgagcgggatcgagtgctcgcaaagcctggagtacaacgtcacggtaaagcaccttcgccgtacgaggagcgtggtagacgttgccagtagcctcatgtttaatccatcatcatacatacgtgtcccttgaaccctttaccaaccccgtttccctccggtcaacactcatctgttctcttggtccgtctgtttctttatcttccacataggagtgaaatcctgcagtatttgtctttctcggtctgacttatttcactcaacatcataccctcagggtccatcctcattgttgagaatgggacgatttttttcctttttcatggctgagtagtattccattgtgtataaataccacatattctttatccaatcaccagtctatgggcacatgtgttgcttccgcgtcttggcccttgtgagtaatgctgccgcgatgaacataggggtgcacgagtgtctttgaattgctgatttcctaaaaccgtcattttttttaaaaaaaaacctaaatagtatcgatatgcgacaaggtctgttctctaagcaaccagcaaatgactccatctatctcaggccagaaaaaaccagtact

SEQ ID NO: 56 - DNA, 8711 bp, Equus caballus; identical to SEQ ID NO: 55

SEQ ID NO: 57 - DNA, 13498 bp, Equus caballus
tatcatctatctacatctatcatctacttcctatcatctatttatcacctatccgtccatacatccacccatacatcaaatctgtctatccatttatctgttccatctatctatctatctatctatctatctatcatctgtctacctatcatctatctatcatctatctatgtatcttccatctatctatctatctacctatctctatcatctccatcatctatcacccatctatctatgcatcatctatgtattatctatcatctatctataacctatcatctatttatcatctttatgtccacccacccatccatccatcatatgtgtctatccatctatccattctatctatcgattgattgatctatcatctgtttatcatctatctatccatccatccatcatctataccatctctctatgtatcatctatgtatgtattatctgtcatctatctatatcctatctatcatctatttatcatcaacctgtccatctgtctgtccatccatccatcacatctgtctatccatctatccgttctacctatcatctatctagctatcatctacctatctatcatctatgcatttaccatctatccatatctatcatctatatcatctctatcagccatcatctctttattgatgcatcatctatttatgtattatctatcaactatctataacctatttatctatctatcatctatctgtccatccatccatccatcatatctgtctatccatctatctgttctatctatatatccatctatccatctatatcatctgtttatctacctatcatctatctacgtacctatctaccatctacctatctatctaatctatctatgtattaccatctatcttctacccatcttctgtgacagtgatttgcaaccagagacaagtcactcccccaggatcccttggcgatgtctggggacatttctggatgccacaactggaggggatgctcttggactctggcgagtggagaccagggctgctgttcaacgccctacagtgcacaggacagatggcccctaccacagagaatggtccagagccagatatcagtcccgcccgggtaaagaatacctagggtagctaataatatcaccccaggtaagtcacttatttttctacatattatgaaaaacccaaggtctgtgcttctggccgcttgcttctgtttcccagctcggtcatgacctcgttctgatgatttaggaactgctgagatttgtgcactctctggtttggcacatcagcgctccgtccgccattttccaggcagagtcgccatttgtcctacctggtgacgcttccagtcatttttgttggggaataattttgcataaataacttaaccgtgagtcattcttcctgacacccgaggcgcgtcctgaaaacaaatcctgtgctttttggcagcttctggagcccccttcaccatccaggactgttttatgactcccgccagccccggggaacagcacgccatcatttacgcctcgcctcccaggttcctcaaatgctaggaaatcgatggtcgtatttcactctgctttggtgcctctaaaaacgcccgtgggaagaatttcaaagacctgcagaaaattatgaaaccggattgggtctgttcacgttcattttgaaggctgctggaacgtcttcatcctttttttctcccttttccttacgaagatgaggagcggggggagttttcaatgcaagcaggtattagtttccaaccccgttggaaatcccagcacagaagacgtcccaacgcaatctgtgcacaaacggaaaatgaaagtggagattccgcacaggcttgttctgttccatcggtcagtctggttcggttcaaagcaacacccacgggcacccggcgtgtgggatgggaagacaagggaaggcgtgcactttgaggtgcgttgcattctctttgtgaacaaagacattattttgttgaagtgaggagggttttttttctctctctttttttttttttggtgaggaagattggccctgagctaacatctgttgccagtcttctgtttttgcttgaggaagactgttgctgagctaacatctgtgcccatattcctctactttgtatgtgggatgcctaccacagcatggcttggtgagcgatgtgtagatctgcactcgggatccaaactcctaaactctgggccgccaaagcagggggcacaaacttcaccactccatcccagggccggcctctcacttacaatgtttttgaggttcatccatggtataggatgtgatggtactccattcctttttcagggccaaataatattctattgtatggatgtacaataacgcgtttttaatgccccctcgactctcctaaaatgaaatccttatactatcacctgtagacaaatgtaataagtccacataatgcaatttataacaaggtgataggcatttgaacacgtccgtgcttggacctccaacctgttccctggagatgacgaagatgaagacgcttgcctctacacgttgaatccccaagaaagcgccgcctagaaaggatttccccagcatttcccccaaatggggaaacagtccaacccaggacaaccttccctttaggaaggcagtgggtgcgtgcctggaaaatcccatctcttgcattcatgggtaaacagagttaagttctaggctcgggttcattatacacaggattttcacctgcggggacatctggccctgaagccccaggggcagcataactcccttgaaaagacccttaaccgacttaaaacccttttagatccaccctttcctccgagtcgtataagcacggagcgaccccctgagcggaacgggacgctctactcgagccacgcggttggcagtggacgtcccgtggtgcacgtggaagttgaaacatcacgtcgcacatcttaaacatatacaatttttattggccagtcgcgcctccataaagccagagaaaactaaagccaagattcctccacaaagtgacggtctccttagttatcaggcgatggttttcccaggatatttggaacgacaactttccacctggcgccacggtggaccaggaataccgcggggtctcagaaggacgatgcacataggttctggggcaactagagcaaatgtactttttccatgcattcctggacccacaacagcaaaattatcattttttaattcaatgtatttgggaatttgaaaatacccctcgaagtaacccatgggctcaagaggaaaaatgaaaacgaggatcgcactagatgtccatgaggtgtagacccgggaggcaaggacagaaatgagtcacccaggatgctacggtgagaaatacgaaaactgagaaataaacggcagtcatcaaaccaggaagtgaggcaatgcatcccagaataaaggcacagaatcatgaggaaaaaaaggggagaaatttatgcaatcgatacaaccaaaaatggtaaattaggaataaacacaaagatgggtaaaggtctgttcttgaacccaagaaggtgcttccttgaagagagacccagagaccagaaaatccccaagctttttcctatgtacggatgctcccgtctgccctctccgggcatttgttggaaagctaagaatttaggtcgaatccgcaggatgctggtatccagacgacagaaaatacaactgccatgatttttttttttttccctcttacatgacaaattcaatggctacagagcttggatgcaaaaccatgcatggtgtttacacccctgagcattcctcaaccagaatgcacaatgcattcagcaagcccgggtgtagacagggggcgtgtgaggaccgtgcgatgcaggaggaagtggaaagatgcagactcaaagggttaatcatggcgcccaatgcaagacttgaccacccaaggctcagaccaagtgggaaatggatgtggggcgccctccgggacccaggggtcaaccctagaagcttccccatccagcctcccaaactggatccaaaccccgtctttcagggaggctggtgtcccttgtagggttttccgtcctaacagccaagatgcgtccatggatagagaccccctcgcaatccagttggcacctggaccaaaggatcctaagccgtgttgggtcctacccggaccggcctttgcagagttcactctttcccgataaaagttcccgttaccacgtacggcagcgcccccaggttccaggcctcaggacctggtgtctctggggtccgtgcgtcagctcgccacaggcctcaagctccttcaggacaggggttctgtcccactcaacccggagccccagcgtttccacagagaccggctcggtagtgatacttaacacacatttaatgaatgaatgaatgaatgaatgaatgatggggtcctttccattattgaacctgaacacaacacacggatgctacacatgcatcaagggtccaactattcaatccaattcaggtgcacggaggccctcttggttcccccgaccccagcgacaggctcaaccagtgtcggcccggctgtggattcagccttactcaccccgccgtccacgcgattccattagctcctgagaagcgtctctgagcggcgtggaatcttacgatcggggggctgcggggcgcatgggaacccctccagaaacggctcatctctccacgtcgggtgttgaggactcgatactcatcctcagagagacgatcgaaccgtccttgcctggcgggtgggtccatgtggatgaaccgggatgatctccccgtcgtgaggtcttcaggacatccgcaatgatcctttttccaaacgggatcacattcacgcgtcgtgggggttgggacgcagacgtgtgttttggggggggccacgttgaactcctataggagccaactggaaggaaccccaaggactcgcccgcccacgggcccacttccaggtcatagagagtggccttcgtgctgatggaggatgagttgcctggacctaaagatacaagagggtcgataaggaaactgtgagttcgggaaggccctggagaacggggacagcgtttggcgtgcaataggattatcatcatattagcaccatggtttgcaatatagtgcgtcctgcagacgtctccaagagaggacatcctgaatgaacagaaaatggacagcatggggcagagacgaggagagagctgtcctcgcccccgtcctacagaatcccatggtgagtggagtccaggccccgtccccgtccccgtcctacagaatcccatggtgagtggagtccaggccccgtcctcgtcctacagaatcccatggtgagtggagtccaggccccgtccccgtccccgtcctacagaatcccatggtgagtggactccaggccccgtccccgtcctacagaatcccatggtgagtggagtccaggccccgtccccgtcctacagaatcccatggtgagtggactccaggccccgtcctcgtcctacagaatcccatggtgagtggagtccaggccccgtccccgtcctataggatcccatggtgagtggagtccaggccccgtccccgtcctataggatcccatggtgagtggactccaggccccgtccccgtcctacagaatcccctcgtcctctgttgacacccctccatgactgttgggcccagacctcatttgagtggctctgaagggtgcaggggtcgcccggggaccgtccatcattcaagatggcggcatagcatgggcattggtcccatgaccctaagacccttgagggcgcatggacccccatttctgggacccgtccatcaaagttgggtcttgagtccgtgggacgacgtggggaccaagcaggcgagcggggaaacatgccgacggggcgccctcacccacctgaacgcctattcctcccgccgtggcagcgacgccgggaagacgccccccgtcccgtccgggatgccggtcatctggcagctcctggcccacagctgtcgctgaagcttcaggtcgtaggtgacggcgagcgaccgggtctccttctcgttgtaaaggtagcggccgccgaccccttccagggccggggcgacggccgcgtagacggaggtccaggctccctcctccggggtctgcggggcgagaaggacggaaggaaggaaggaaggtgagacgcggcgactgccggagcggagcgcacgggacgctcggggctcagggagaggccgccggctgagacgggaggctcaccacctgcgtggacactctcacgcagaccgccggggtgggcaacctggcagaaccagaccccggggccgttgcatatttcttttcatcgcgtgcggacaggaacgcacgccctcgtgggcttcgaaaagtctataatctctgaagacggggaacagaccccagccgggaggctatgtgactctgtctatggagggaaagacgcattcctggagacgccacgagttggggtcggggccaggtcaggaaggggtaggtgtgggggagacggggacacggaagggggatgaggtcatgaaggggaccctgggtccattaaaaaaaaacaggcattgggccggcccggtggtgcagcggttaagtgtgcatgttctgcttcagcggcccggggttcaccggtttggatcctgggtgtggacgtggcaccgcttgacaagccatgctgtggtaggcatcccacatataaaggagaggaagacgggcacggatgtgagctcagggccagtcttcctcagcaaaaaaaaaaaaaaaaaaggaggaggattgacagcagatgttagctcagggctaatcttcctcaaaaaaaaaaaaaaaaaaaagagatgcatttcctctaaataggagacatctcccagaactcacacagcctgtgggtctattttaccgaaaggaacactgaatttacccatcttcctggggcagtggctgcgaccagcgtcctgtttcgaccccaaccgggcacaccgtggctcaattctgccgctgcccacctggagtcagcaaagcctgtgcgtgtctagggcttcagtgctcctgaaccgccccacccaaaatgccaaaggaggctcagagaggtctcctcctttgtcaagggcacacagctggcgggtggaggagccgagattcaaacccaggaccaccggctggctcccggtcaacattctcacccagagcacgtgctgccctctcccagaaacgactcagaaaaggctgggctacgcggaggggagagtgggtttgaatccacatcataattagaatgcacaacgcctgacacaggatgagtgtgtccccctcaattcacaggttggggtgctgagacccccccaggacctcaggacggggctgcctttggagatgggccttgaaggaggggacggaggtgaaatgaggggtttggatcccgaagcccagggtctgccttggtgaattgtttccatggagttctctctctgtctctatctccaccacatggagacagaccaagatggcggccatctgccagccaagaagaccatgctgacaccttgatcctggacgtccggcctccagaaccagatgtctgtggcttaagcgccccggccgggggactgtgttacagcaccctcagctgatgactgtgtgtcccaacaccaagctctagatttgaagggcgccatgttccaggtgatcaaaaaagcacgaagaggaaggaaacaccacattttgcctgaatccctagaagctagaactcggggtagtaatggcggaaggggcttcggcgggagcagcggaaatccctatggcatgtccttgtgccaggcacggcccgaaacaccaccagggaatccttctgactcactcccctggtccgcgagctctgaatccacgtccacggtccatgagctctgaatccacgtccacaatccatgactctgaatccacgtccacgatccatgagctctgaatccacgtccacgatccatgagctctgaatccacgtccatgatccacgagctctgaatccacgtccccgatccatgactctgaatccacgtccctggtccatgagctctgaatccacgtccctggtccatgactctgaatccacgtccatggtccatgactctgaatccacgtccatgatccatgactctgaatccacgtccccgatccatgagctctgaatccacgtccatggtccatgactctgaatccacgtccatgatccatgactctgaatccacgtccatgatccatgagctctgaatccacgtccatggtccatgactctgaatccacgtccatgatccatgagctctgaatccacgtccatggtccatgagctctgaatccacgtccacgatccatgagctctgaatccacgtccacgatccatgagctctgaatacacgtccatgatccatgagctctgaatccacgtccacgatccatgagctctgaatccacgtcccgggtccatgagctctgaatccacgtccacaatccatgagctctgaatccacgtccatgatccacgagctctgaatccacgtccatggtccatgagctctgaatccacgtccatggtccatgagtctgaatccacgtccctggtccatgagctctgaatccacgtccacgatccatgagctctgaatccacgtccatgatccatgagtctgaatccacgtccctggtccatgagctctgaatccaaatccatgatccatgagctctgaatccacgtccctggtccatgagctccgaatccatggtgaacgagctccaaaattgctctttccgaggagatggtgggccggttgggcgcacgcccccggggagaaatgtaatcaaaggcgaacgcagtgggacgcgggctggatttgaaaggaggctaagtggagctgaaagcgatgcgcgattacggggaaaaaaaatgcatgcctcctaattacctaattacacagcgctttacagttttggaaattgcttccgcgtctactgtgtgagcaatttccacaacactcttatgagatattattacccagaaccaacaaattacaaacgcgaggggcactgcgggggtgggggggaaggagctgcgtggaacggccagacttggcttcttccagagacccccccaattctctccgtcttccccctcaaaacccctccatcctatgggcccatgatccatgcccatggctccagaaacagaacggtcgtgatttgtctgtgcaaaaaaaaaaaaaaaaacacacacacacactaagcccctcctctttataaatgtgtagatctcccgtgtgtttctcaaggtactaaccggcttgcccagggctctgaattcaagtccatttccttttttttttttttggtgaggaagattggccctgagcgaatatccgttggcaatcttccccctcctctttttttttttttttttttgctggaggaagattggcccggacctaacatctgtgcccgtcctcctctactttgtacgtgggatgttttactgctgaaagaacttaagaatttgaaagaagcgtttgaagcccctttgcctgaggcgggaggggataaaagatgagttgaggagcaagcgaaggaagagttggggagtccatcgacccttccaggagctctgagaaaaatggggaaccttgagatggaagccggagcaaggaggagggccgatcttgagaaaacagagttaactacgctcatgaattctaaaaggggatgcaaacacacaaggatcgatcgcagggagaaaggtgtcccaatcgactccagaagggtagaaaacgtgaacgcagggaagccctcagggtccgaccgaaggatgcccaaggacaggacgactgcttctcgaaaggcaggaccctccgatccgggcgacatcctgatctgagttattccaataagggagaaaattcgccaggaagacttcattttaaaaaaaaagcgaaatggggctaacatacagcacagcacataacaaagcaccacagacgatcacataggcaagtattcagataaagaagaaatactgtgtttttccaccatcatcaagaagatattcgatcaattatttaatcatctattgagtggatagaaacaatatcacaagaagcatatgcgttagaagcaaggaggtgatgatggtgagcatttgcagattaaatagttgggtggtggaaaaagatgagagacggaaactcgatgagaaataataaaacgtcggcgatggcatcagttaagatgtggagcatttatcaggagaaacaagagaacggtccacacctcgtcccggagaagggggttggttacctttttgggaggaaggaaggcgaatttggggaaaagcatgcacccgatcccgcggtgtgtgcgctcactttattaccgacttttaaatattttattttgttgtattcacggtttgccaattttttttaatcctcttcacggcggaaacaaacattccaacttcctaaataacgacgatgaacgcaacaggaaacggacgggaatgaataaaaacacctccgaaaagcattcagattctggtccccaggcccaacgtggaagcggattgtagacgttcagaaaacagagacggtcgtcacgtgggatcgtcacacagcgatggagtctcagacacacacgcgcgggacccaaggccggacccgggtcccagattcagcaaaataacgagcaggtgccttcgtcgtgcacggctccctgcaaacaccctgccggccgcgaattgggttgcaacgaggaaaaaataccccccaggggtgaatttctcaacaagaacctaacaaaaatggaactgcgttcgggcctaaagtccgctctctgagaccagggctgctgtgatgctcacacccccgagtgtggacataacgagttcatcctccttggtggttcttgcgccaaactccgtgcaagcgtcctggaggtggcggcccgcccgtgtggcccgcgctcgcacagtcggcacggacacgggaaccgtcggggacttaccttgaagatccaccggccgaacagcttcttgaccagacgcgtgggccagaagacgtgtttgtagaggtcggtgtcgaccacgccggggtcggccacgttggcggtcacgggactgccctgggcggccagcagcccctggaggtgataagtgaagaggaccagggccagcttgctctgggcgtaggccccgtgcggggagtagctcctgctgtggagacaaaggaggagacggcgtgagaggcggtccaggcccagagtccccaccccgtgccctgcagccctggccctcgccacgtccatttgcagccgcctcccctttgcaggctggcctgctggcgtcggggttatgaaatttgcacgctctgcctcagcagcccggggttcacaggtttggattccgggcacggacttagcaccgctcatcaaccacgctgtggtggcgtcccacataaaatagaggaagatgggcactggtgttggctcagcgacagtcttcctcagcaaaaaaaaaaagaaaagaggaggattggcagcagatgttagtgctcagggccagtcttcctcagcaaaaaaaaaaaaaaaaaaaagaggattggcagcagatgttagggctaagggccagtcttcctcagcaaaagaaaaaaaaaaaaaaagaggattggcagcagctgttagtgctcagggccagtcttcctcagcaaaaaaaaaaaaaaaaaaagaggaggattggcagcagatgttaggtcagggccaatcttcctcaccaaaaaaaaaaaaaaaaaagaatgacagggctggcatgcacacaccacgaggccagagatcttggttggagctgctcctttttccaatctgtggggcgatctcgaggacctcctttaaatttgaattttcaaggcttggggaagacgggccgacatctctcgcactccgatgcagagcggccagccgccccccgggtcggttttttgctgccgacgggaacagagagatgattttacggggtgccaacagcctgaaaactgggagggcgtcacggccaagcgcatcctttgtcactcaggagtggcggccattcttcatgccaatagttcttttttcctgaaatttaactttatctgctatccaccagctataaaaaaaggaaaagactagatgccccgtaagctaacctatttattttttttttggtaaaataaaggaataaaaatgaggacatgtgcctattttcccgtaactctggttaaattccacgaagtcatccttcctgatgctgaaggacgggggacggggtccagatgtgaaaaggaagggcccgcgcccacgaagccaattactgtctctttgtcacgggcaccacgaccacgcgtatccacgtcgttaaaattgtgccaatcgttgaacttagtaacgccagtgtctgaaatgcatcccggaaaaccgtaacaatttgttactgttacatgacacagtgttacgttattgctacattgtagttaataactagtaacattataactaatatttttctttaaaattgtgtctatagtaactccagtgtttgaaatgtatcccagaaaaaccgtaacattttgttactgtttcattacacagtgttgcattattgctacattgtaattaataactagtaacattataactaacatttttctttaaaattgtgtcaatcgttgaacttagtaacgccagtgtctgaaatgtatcccgggaaaaccgcaacaatttgttactgttccattattgttacgttacagggttacattattgctacattgtaattaataaccaataacatgataactaatatttttctttaaaattgtgtctatagtaactccagtgtttgaaatgtatcccagaaaaaccgtaacattttgttactgtttcatgacacagtgttgcgttattgctacattgtaattaataaccaataacatgataactaatatttttctttaaaattgtgtctatagtaactccagtgtttgaaatgtatcccagaaaaaccgtaacattttgttactgtttcatgacacagtgttgcgttattgctacattgtaattaataactagtaacattataactaatatttttctttaaaattgtgtctatagtaactccggtgtttgaaatgtatcccgggaaaaccacaacaatttgttactattatattattgttacattataatgaataactagtaacattataactaacatttttctttaaaattgtgccaatcgttgaacttagtaactccagtgtctgaaatgtatcccggaaaaccgcaacaatttgttactgttacattattgtgacattacacagtgttacattattgactacattataattaataactgacattataactaata

SEQ ID NO: 58 - DNA, 1971 bp, Equus caballus
ccccactttcgggatttgcgagcccctccttaaaaatggggcatggcccttttagacgctcatttttaatccctattttccccctcttcggcggcccgtggaggacgcagtttttttgtagccccttggcagaagccgggctcctctcaaaaatttccctccctttttccaaattgcacacgtctccggtaccaaggcgggctccacccctcaaattagcgtcaagatctttgtttttcggcaatatccctccttctcctgagggagtaattaacccagccttgtgggctgggggggggggagtgaaggctgagatttcagttaagtgtcacgggaccagcctcccatccccaaattagcccaagaggagaaggaatttcagaagaggttgcctgcacccgggatctcaacccgcaaaccccaggccgccaaagcagagtgtgcgaatttaaccgctacgccccctgggccggcccggaaacatggcatttttaataagcagcttttgtaatcaatgatgccaaaaggtaggactgacaacataaaagtgtatcattctttccaatagttaatcctttattaacgtaactacttcaagaataactcaaagctcagtctgaaacaaaagtagagatggtaacgtgacggccttttgtcggggagggaaatctttttctccacactcttaggtttggcgactggggcctgcaaattaaacggatgagtgacagattcacaagagaaaagtatacagatttcattttgttcaactttacatgtatgaggggcttcctagaaaagacatgaaaaccccaaagagacagttagactcaggggctgacatggcatttaataaagggtgctaaattgcaaccgtgaacaatcttatgtgttctgaggatgagagccaggaccagggaacttgcctgccttgggctggggcacggagacaagatgacccgacttcctttttggcccggggcatcccagtaaacagccatctgccttaaggggtgagggtcagaggacagtcaagatgccctattccgaggagaggggcaatgacgtcttcccacgcggggagctcggagaagacccaccgaggatctctttggtcctgaggcgcccacgggtacaggaggctgggcacggcagacggaccagggtgctgagcaggtaggaggcagaacgcccccgccggacaccacgaggtgtcactcacccctgccattgacagaactcctcgcccacatccacgcctgttgtcgttaattttacacgtccacgtggccaggctgtggtgcccggttgtttggtcaaacgtgaatctagacgttgccgcgtttttcagaagtgattagtaacgggtagagtaggaggaaagccgatcgatgcctgcctgctgagggtgggcctcgcccaatcagttgaaggcattaagagaaaagattgaggttccccccaaaaaggaggaatttggcctgcagaccaccgcacagaaatcctgcctgacttaccagccttgaggctcaagattgcaacataacgcttacgcagatctccagcctgctggtccacccggcaaattccagactggccagcctctctgtgggagtcaattcctcaaaaaaaaaactcattgtctctctcatagatagagattagatagatagattgatttctttacctataagatatattatatatatttattatatacttgtatatcataaatagcatgtagatatatatttaaaaatttttataattatatatttataatctttataaatatatttatttttatattttacttatatttaattaattaattaattaattaattaaatttcttaaatttttgtttatttaatttatgtattcattatttgtaatatttatattatattttattatacacataatatattattatatattatatatttattatttgtattatttttattt

SEQ ID NO: 59 - DNA, 18755 bp, Equus caballus
tttttttccaggggagcgaggaaacccggagctctcaggtccaagagattcacatcagataaaccaggtaagtccccagagcatcccatcaagggtcccacagcgcatggctctcagaaaagagtcagggccgggtcttagaacaaaaggttgcagcgggtcactccggagaccacctctcacgtcagattggggtctaaaactgaataggtcacctagcccggtttgggcgagcgttcccgacatgcctgggtcactgagcctggggaggcctgaatttgcgcacccagagccccggctccctggatatccggagcctgttcttagagttccccttgcgcgctcgcacgagcggccccaggctgtgcggcggtgacccgggcagcgcggaagaagaccctgcagcttggccccggggccgcggggcgcgggctgtgcggcggggcgggaggcacgtctggttcatgggcgaggtcgcagcggcgccatagggcgtgtggctgacccaggggcgcggggtctcggctgccttcgccctcctcccagccgcacggagctgctgcagaggatgcgcccgcccaggccgcgctgggaccaggaagggttttggcgggaaagtgcagcccttcagtggcgatggtgattgaggtcaggggcagcccctgagacaggctcctaggacatagggctggagacccccagcacggcgccttcccggggccgccctcctgggtttcctgggcactgtcgtgtgtctgagaatgacgtgggcctggagacctccagtgcagcctccttcctggggctgccctcccggggttcctggggctggtcgcgtctgagaaggacatcaggctggagacccccagcccagcccccttcctgaggcctccctccctgggttcctggggccggccaggtgtctgagaaggaaggcatgcctgagcgcctggggcgggaggtgttccggagctctgaacctgactctgcgctcttcttccttctggctgaggacgaggccccagccaatgagccgtgggggtgggacagcacagtgactcagcattgtgggcagtgactcgtccccttcaggtttgcgcagttaagatgcaagaagatgtgcagttagttgtgatgcatggttgcaagttaagggactgagccggaagtcgtgtccaaaacaggagttcttgaagaagggtgccttggtctgtgtgcatgtgggcgacgggcgccacgacctcctgaaattgtgtagaggtggtctatatatttgtgaatttccatttttcagtaatgaaaagatacatgcataattcagaagatttagacctgagtttttatctggaatcaaaaattgttataccttgttgtggttttgcacaaagttagtgatcaagataatgagaatggggccggcctgtagctgagtggctggatatgcgcattccacttccatggcccagccttcaagggttcagatcctggttgctgacctgcttctccagccacactgaggcagcgcccatcatagtaaaaccagaaggacctacactaggatacacaactatgtacttgggctttggggaggaaggaaaaaaggacaggaagatcggtgacagatgttagctcagggccaatcttcctcaccaaaaagcgaaaaagaaaaaataactttaaaaaagataataaatggtaagaaaagcacatgatacccatgagagaatattatgcagatattaaaattcctgttaaataagtatgagtcattataagaaaaaaatggctgtgatgtgctgttaaaccgtcttcatgattgtggagaataatactgaaaaaattttaaattatacgtgttcatttaaaaattaaaatattgtaggggctggccccgtggccgagtggttaatttcgcgcactccactgcaggtggcccggtgtttccttagttcgaatcctgggtgcggacatggcactgctcatcagaccatgctgagacagcgtcccacgtgccacaactagaagagcccacaacgaagaatacacaactatgtacccgggggctttggggagaaaaaggaaaaaataaaatcttaaaaaaaaattgaaatattgtaaaacccttggcaaggattgtatccaaaatgatattttaattgttattcagagaggaatggaagatgtgtagtcacatttattaaacaccttctgcgtcctcaaaactttttgacacattttgcctacgtattctcattaatctgcaaaggccacttccctttctattaatgggagaatctttatagtgcaatgtctgatgatgtcagtgtgggacacctaaaggagattcaagaacaggtccatggtgtttgcttcaatcacagtgagttttcatggcaggcctagtgctaaaagatttttttaaagacaaaaacacagcctctgccataatgatgacttaaaatattttaatactttgaaacatcttcatgttgcatttatgatgatagaatttaatgcagacttactgcaaaaaaattaattttctaaggaaatttttaagaagaaaataagaatattctttcatcccactgcatagaaataatcactttcaatcttttggtgtatatgtttctaggttttatgtgtgaacatttctgtgtcgttttgttttgatagaacataactggtcaaatgaaggagatgaagagtcctgctcttagtttgaaaaggagatctaacccaatcaagggtttccttataagtgccttagggaaaaggatgtgccgggaatctctttgaaatacattctattttcaccttttagatattagaaattttatttaaaatttaattatcgtggcaccaaattgctaaatgagacatcctttcagaattaataatttagcgatctaaggttcctttcggagaaaataacactaatttcttactccaattgtcttgcaagtacaaataataaataatataatattttcacaaataaaaaatgtgacataaatctccatattgtgcaggagaataagattcacttgtttgttaagattctgcattttgtcacatcctgtttacgtacatgtaggtttgtgatgctggatggggtttttcttgctcgccgtagcttctggggactgaggaaggggacattttctctctgtctggcaatttctctcttgttactaacaattttattaagaagaattatattttctcaaagataggaactggaacttctaaaattaaagataaagcccagaagcacaaattttctataagacaaatgatgcagcaaaattcactcgctcgtgtaataatggattaaggggcgtctactgactttcaccttcaataatggtagataattatgtattagccattgtgatatatctttttgtatttatatggactatctcacttattcttcaaaacagacttatgtaatcggtgatattcttatgctttgtttgctgatatctcacttattcttcaaaacagacttatgtaatcggtgatattcttatgctttgtttgctgatgctcacaacagaccctgtgttcttattttcacaagatttcacctcattttgaattcctaaaaatctcacaacagaccctgtgttcttattttcacaagatttcacctcttaggttgtgcatacctttttaaacctgccttcttgactgagttaatattgttttccagcatttcatatggattaataatcagtgaagccatagtatgtcaccatggtgcagaccataatatgtttaacctgttccttgctgtgaaatagttgtgtttttaatttttgtttatcaaaaattattctctgtggcctggcctgctggtgtagtggttaagttcgctcacttgcttgctccactccagaggcccagggtttgcaggttcagatcctgggcatggacctacacaccaatcatcatccaagctgtggcagcatcctatgtaccgaagagaggaagactggcacagatgttaactcagtgcaatcttcctcaaacaaaaagaggaagattggcaacaggtattagcccagggccaatcttccaccccccaaaaaaaaaccaaaacccaaaaaaccccacggttattctctgatgaacatccttgtgcacaagtacttctatagttatctcctttaaaaaattccttgaaatgaaattttgtggtaaagagacttttatgaactacctacaatgtgctaggcctagagattgtaggatttggggtaatacaatcacttaaaagacattattgcttcctttatgatgcttattatctaaaatgaaggtaaaatctgaatgggaataagctcaaggcaatgtgtgatgaagagcactggagagatttaggtgacttacctgttaattcagtctgtctatagcaacagccaggatatgaacaaaatatactgattgtatggaatatctatggagtaaattgattttctactgtgacttttatatttacagtttcccttctaattttgttaggtataaagtgaaactaacagggtatgacagttcagcagacgtctgggggacattatggcttagctgacaggtttaggaaccaaataaacctgtctgtcaagaggacctggaataaagctgtattgaaatcatcatcagttcacacaagaggttacacagagactgctccctattttttctagacagaactctgtcattcctgagaagaaaggatagggttcagatattggattgaaaggaaacggacaaaagataagccattcagtaagacaatctacatttagataacaaagaattttcttgaattctcctacttttggacatcttcgtgttaaaaaataaagaaaaaatgcacacagatatagttcaagttaacctatggtcattgttacaataattatgaaataagctttaaaaggcaacgtcgagattaaaataaagcagcattattaggtggtccataaccttccagactatctgtctactgatgtcagtggtctgtttctccaccactctttctctctgttgattgatacattcatgtatttgtcaagaatacataattcaatctaattattatgttgatagcatatctggaatatttcccatatccataaatattttttcccaacttcacatttcatacctagtttgtattgtagtatgatgatggtttgtcatgtatttaattagcaagctttactggactcaaaatactgagcactgacttttcatctccaatgtcttaaccaacctccaaagccacaaaagaggttctggctagacgactatgggctcttttcagtcttagaaggtgttaatagaaggaagaggatctgctcagggcatgacttcgctggacatgcttaagtctccacctgcctcaccagaaggacgcagtggccggaaaacttcctgttgacatatctgggtctggcttcagtgcagaaatgcctctgttctatgacttttttcagcagagacccctgggatttgagggagaaaatggatttatctagaatcctcatctgctcaagtcatgcagatgggaaataatttggaacctggcgtggaagatcataacaaagttattaacttgagtcctgttgggaacgctaaagcagaactggtctcaagatccagctcttcccccagctttggctttctggaactgtgcttttctgatagaggaaccctgagactgatgcgctcttgaaggtctaaaaccatgttccatgtgagttgatgtttctctccttgaaatacatttattttgttttgttatttaggtcatgtgagtatttttattagtttttctaaagtttactaccaagagagggccctcaaataacctatgtcccaccgcttgttccagtgaaatgtgatagcaaattacccagcatcctctctatgtagcccattctaaactaactagtgttcgtgttattactgagaaattactgaacatatctttttttgggggggttacccaattactttatttgaaggaatggtacaaatccaagaacttaagtagatgttttggtacaacttatagaaaaggtaaaggtaaccccaacatgcatgcactgcctcggtggatcagggaagtcacccggtggctggagaaagctggcctgagacttagctctcatcactgtctcccagggtgtgcttgtcagagagatactccgccatgccagattccggggcccccatcctgcgcaggttggttacgtggtcacccaattctttgatggctttcacctgctcattcaggtaatgaggctcaaggaagtcacacaggtgggggtcatttttgtcagtggccagtttgtgcagttccaatagtgactcattcacttttttttccaagtataatgcacactccattgtcttcagcccattctcccagtcatcctgttctggtttcttgatatcctgaaggaagatttggcctcctccttggttctgcagcttcatcagtttctcagcatgttccctctcctcatgagattggtgaagaaaatatttggcaaagttcttcaaagccacatcactgcgatcaaaatagtaagacatggccaggtagatgtaggaggcattcagctccaggttgagctgatggttgatggcggcctccgagtcctggtggtggttctggcacacctgtgaggggaccgcagtcgtcatggcagacggctgaggagaggagggggcggcggcgggaaccttgggcgggccgagggcactgtgaggaggtcactgagggccggctctgggtggctggccggggcagggagccagcaccggttccgttcaagcactgttgaatcaggaaactgtggcaactcggacgaagactgtattgaacatatcttaagtgtccattctttgtcctttgaagtaaagatttatgctatttgagtcaggtctgtagtttggtgagatagagacaatggttgtgtttaaccctccatgagaagactttgaagttttctgcagacttgagatttccaggtaggtaacatagacatttggtatttaaagacccacatctcagtgtagagtgagatctcgtggtttgtgtggattagtacaggcatatctgagagacattgcaagttcaagttccaggccaccgcaataaagcaaatcttggaataaagggagtcacacatatttgttggtttcccagtgcatataaaagttatctttactctatagtctattaagtgtgcaatagcattgtccaaataacaatatatgcaccttaattaaaaaaatactttattgctaaaaagtgcaaaccatcatctgagacttcagtgagttgtagtctttttaccaatggaaggtcttgcaaaaacacaatatctgaaaagcgcaataaaacaaagtgtgataaagtgaggtatgcctgcatatgattgagatttgcaaacttggaggttgtgaatcttggcaggaaatgtctgagagataaatatcaagactagtttattgttgaatcagacatactaaatttggatgtcatctacataattcgttacccttcctcaacatttttttttttttaaagactggcacctgggctaaaaactgttgccaatcttcctttttttttttaaggattggcacctgggctaacaactgtttccaatgtttgggttcttttctgctttatttcccaacccccccgggtacatagttctatatcttagttgcaggttcttctagttgtgggatgtgggacgccacctcaacgtggcctcacgagcagtgccatgtcctcgcccaggacccgaaccctgggccgccactgcggagtgtgcaaatgtaaccactcggccacggagccggcccccttcctcaacattctttacctcaatctatgagttatctattcctgcataaaaaattaactcgacacttagtagcttaaagcagtaaacgtttatctcacagtttcaatgggtggcaaatctggacgtggcttagcttgactctcctgctctgggtctctcaccaggctatgaagatgttggtcagggctgcagtcttcttaaggccaacgttagctgcctctccttccaagctcgctcaagttttttttttttttttattaatgttatgatagattacaaccttgtgagatttcagttgtacatttttgttagtcatgttgtgggtacaccacttccccctctctcgctcaagtgttttttaactggatttagtcactcacgggctgttggctagaggctactctgtgttgagcaagcgagacagccaaagagggcaagcaatatggaaatcatcgtcttttgtaattactatcagaagtaacatttcatcactgtagacattttctgtttgtttaaagcaagtcactgcttttagcccacacacagggccaggagagcacacagggacataaatacgaggaggtggccctcagtaacctaagtagcagctgcttaccatgcttggtgtaaggcatgtgctcagtgacagatggtggacagcaacaacaaaaagtcctcctaagcagtcagtgaagacagactcacagaattggggaagacctcacaaatgctgtgcatcctacctgtataaatgattaaatctgatatgtccataaaatataatgtcatgtgccaaagagtacatggatttatcaaaacgagaaaaaatgctaagggtaaggcctggcatcatgaacaatttaatgcttgagagaattctcatttttatacagaccctttttcctaacattaagactttttactgcatttcaaaaagtatgtgattaaatgttctcttctctaaaaagtaaaaattttcctgagcaactcacgtttactgggaatttatgtgccaggtcccaattaagcattatgcttgtattcactatttcatttaatagtaaaatattattattctatctattctcaaatggttcacatatgtaaaagtgtgccaggaaattttgtctatttcagcaggcttcgtcaaaaacatacgtgctgctccagcccccctctcatactgtagatttgtagtctacatccgtgctatattgctctcgccctgcaatgcagtcctcatctcctctccttccatcttcaaaatattcctttaatttccctagtaacgcatgggtgtgtttgccatttcagagatctgtgacgttcagcaatgtggcctagacttctctatgctggagtgggaatatctcaaccctgttcagaagaaattgtacgtgtcaatgtgacgatgaagaactgtggcaacttggtctcactgggtatgcttgtcagcttcaaaagacgtagtttaatttagaatctgcttttcaagatatatattttttccactgtgattttcaggtctgcttttccagaaactagttaaatttgtttgttccttttttccaaagaaatggtttgagctttgtcatgcttgacatggctactccgtcaaacaccttcctcttccctgtctttcggtcacactcatacctcctccaatcttactcatagttgcctctcttattttgtgaataaggtctagttgagaattctttggtgtttattataaccattgtcagaggatccagttttcctatttacttatgctcagaatttttatagatatttcattttaatatctgatccacttgcagggagactagcctgacacaggggcctgaattggtctaaaagagcctctacagtttaggtactggtggatttgataaagggaattaattgaacactgaggcatatgcgttgtattttgtaagaactttttgctgttttgtggttgaaagttgtagtctattaacattacatttaaaatgaaatgagtatcctatagatatctcttctcgtgtactcttcataaaacggcaatatcaatagtaatgtcaatattaacatcgtgcttagtatataataggcagtgctcgaagcactttccatctctatatcaacttgtttaatcctcctgacagatttcttattcctgttctacaagtgagaatactgaggcacagtgggtttaagtgactttcccgaggtcaaacacagctggaaggtggcaaaggcaggaattgaatcatggctccagaatctctattttaagccatggtattatgcattctctcgagaaagaggatgtatgagtatatatgtttaaaatatccttaccctacctgatttcttgttctttagctcccttaccccattttcttggaaatcatattcaatatcattttgacctttagtttattattattataattttaagtaaacaatgttttgttctacatcatatgccatttctttctttgtaagcacggcatttcagttctaagctgggagtgattacattattggagcaaggaaagaggcctgcgtggttgtgagggaagaaacaagaagagggcatacaagtaagtatgagcaagtcaagctatgacaatatatttgggtaggtaaaagcccaagtggttaaggaggagacatgcttgaaatgttggctggaaagctccattcacactggggaaaatacttgtgatctagagaggagataaatactctatgagcgacccagtgaatttcatcttcacctcattaactgctcactttgtttctcttctcatatttctgtcccagttcagggatgggcactgttcttcttcctcatgcaccattttatctgtattttttttattattgttatttttttattgagttattgataggttacaatcttgtgaaatttcaattgtacattaatgtttgtcagtcatgttgtaggtgcaccacttcaccctttgtgcccacccccaccccacctttcccctggtatccactaaactgttcttggtccatagttttaaattcctcatatgagtggagtcatacacagattatctttctctcgctggcttatttcacttaacataattctctcaaggtccatccatgttattgcaaatggaatgattttgttctgttttgcagctgagtagtattccattgtatatatgtaccacatcttctttatccattcgtctgttgatgggcacttaggttgcttccacgtcttggctattgtaaacagtgctgcaataaacattggggtgcacaggacttttgggattgctgacttcaggctctttggataaatacccagtagtgggatggctggatcttttggtagttctatttttagttttttgaggaatctccatactgtttttcatacaggctgcaccagtttgcattcccaccagcagtgtatgagggttcctttttctcctcaacctctccaacatttgttgctattagttttagatatttttgtcattctaacaggtgtaaggcgatatcttagcgtagttttgatttgcatttccctgatgatcagcgatgatgagcatcttttcatgtgcctgttggccatcagtatatcttcgttggagaaatgtctgttcatgtctccagcccattttttgattgggttgtttgatgttttgtggttgagttgcgagaattctttatatattaaggatattaagcctttgtcagatatatgacttgcaaatattttttcccagttagtgggttgtttttttgtttcaatcctgttttcatttgccttgaagaagctctttaatctgatgaggtcccatttgtttattctttctattgtttcccttctctgagaaggcatggtgtctgaaaagatccttttaatactgatgtcaaagagtgtactgcctacgttttcttccagaagccttatggtttcaggtctcacctttaggtctttgatccattttgagtttattttggtgaatggtgaaaaagaatggtcaattttcattcttttacatgtggctttccagttttcccagcaccatttgttgaaaagactttcttttctccattgtatgccctcagctcctttgtcaaagataagctgtccatagatgtgtggctttatttctgggctttcaattctgttccattgatctgtgcacctgtttttgtaccagtaccatgctgttttgattactgtagctttgtagtatgttttgaagtcagggattgtgatgcctcccgttttgttctttttttctcaggattgctttagcaattcggggtcttttgttgccccatatgaattttaggattctttgttctaattctgtaaagaatgtcattgggattctgattgggatggcgttgaatctgtagattgctttaggtagaatggacattttaactatgtttattcttccaatccatgtacatggaatgtctttccatctccttatgtcgtcatccacttctctcagaaaggccttgtaattttcattatataggtccttcacttcattagttaaatttaccccaagttattttattatttttgttgtgattgtgaatggtattgtattcttgagttctttttctgttggttcattactggagcatagaaatgctactgatttatgcaaattgattttataccctgcaactttgctgtagttgttgattacttctaacagttttccaatggattctttggggttttatatatataagatcatgtcgtctgcaaacagcgagagtttcacttcttccctccctatttggattccttttattcctttttcttgcctgattgctctggccaggacctccagtactatgttaaataagagtggtgatagagggcatccttgtctccttcctgttttcagggggatggcgttcagtttttgcccattgagtatgatgttggctatgggtttgttgtatatggcctttattatgttgaggtagtttccttctatgcccattttcttcagagtttttatcataaatgggtgttggatcttgtcaaatgccttctctgcatctattgagatgatcatgtggtttttgttcctcagtttgttgatgtggtgtatcacgttgattgatttgcggatgttgaaccatccctgtgtccctggtatgaatcccacctgatcctgatgtatgattcttttgatgaattgctgaattctggttgccaaaattttgtttagaatttttgcatctatgttcatcagtgatattggcctgtagttctcttttttcgtagtgtccttgtcaggttttcgtatcagtgtgatattggcctcatagaatgtgttaggaagtgttccatcttccctaattttttggaatagcttgaaaaggatgggtattaaatcctctctgaaagtttggtagaattccccaggaaagccatctggtcctggggttttattctttgggatgtttttgattgctgtttcaagctctttccttgtgattggtctgttcaaattatctgcctcttcttgagtgagctttgggagactgtaggagtccaagaatttatccatttcctctaggttatccattctgttggcatatagtttttcgtagtattctcttataatctgttgtatttctgcagagtctgttgttgtttcttctcgctcatttctgattttgtttatttgagctttctccctttttttctttgtaagtctggctagtggtttgtcaattttgtttatcttctcaaaaaaacagctctttgtctcattgatcctttctactgcctttttcttttcaatagtatttatctgctctgatttttattatttctctccttctgctgactttgggcttcatttgttcttttttctctagttcagttaggtgtgctttaaggttgcttatttgggatttttcttgtttgttaagatgtgcctgtattgtgatgaattttcctcttaatacagcttttgctgtatcccatatgagttggtatggcatgctatcattttcatttgtttccaggtattttgtgatttcttctttaatttcttcaatgatccattgcttgttcagtagtgtgttgtttaatctccacatctttgtgcctttctaagcttttttcttgtaattaatttctagccttatagcactatgatctgagaagatgcttgttattatttcattttttttgaatttgtagaggcttgcctgtttcccaacatatggtctatcctagagaatgttccatgtgcacttgagaagaatgtgtattcagctccttcagggtggagtgatctatatatgtctattgattccaattgttttagtttttcattcaactccactatttccttgttgattttctgtctggatgatctgtccattgatgtgagtggggtgttgaggtcccctactattattgtgttgtttttaacatcttcctttaggtctgttagtagttgctttatgaatcttggtgctcctgtgttgggtgcatagatatttataagcgttatttcttcttgatgaagtgtccctttgatcattatatattgtccctctgtgtctctctttacctgtcttattttgaaatccacttggtctgatatgagaattgcaacacctgcctttttttccttgctatttgcttgaagtattgtcctccaccccttcaccctgagtctgtgtttgtccttggggctgaggtgtgtttcctggaggcaacaaattgttggatcttgttctttaatccattttgccgctctgtgtctttttattggagagttcaatcctttcacattgagagtgattattgatgcatgtggacttaatgctgtcaatctgttgctcattatcttgttttcctgtgtttcttttcctgtgtgctttagactatccatttattactgcaatttcttatgctgggtttcttagatttttccttatctatgatttgtgactctgttctgtactttattttagtgtctaccttgaagtttgtatttagaatctcgtgtataatatagtctattctctggtgttctcttacttactcgaccaatactgacttagaccctttgctcttcacctcctaaataattattttcattttttattcctactcgtcttattaatttgtagttagagtgctaagatcgtccttgttttggtagtttccttatttttaccctaatgctatagttgaatatttgctatcctgttctggttctatccatcggtctccttagtctgtggcttgtgtcccctttctccattttttcttttttcaagtatgagagccttctggaggatttcttgtaatggagggcttttagttacaaattctcttaacttttgtttgtctggaaaagatttaatttctccctcatatctgaaggaaattcttgctggatagagtattcttggctgaaggtttttatcctttaaagctttgaatatatcactccattctctcttagcttgtagggtttctgtagagaaatccgctgacagtcttataggggctcctttataggttattctcttttttttccttacttccctgagtattctttccttatcattcctatttgccaactttactactatgtgccttgcggtgggtctttttacattgacaaatctaggagatctaaaaccctcctctacacacatttctccgttgatccctagatttgggaagttctcttcaataatttcattaagcacactttctgctccattttccttttccatattctcgggaataactatgatccttatgttcttactcctcattgaatccattatctctcagagattttcctcatttttcttaactcttagttctctttcttcctctgtctggtgccattcagcctgtctgtcctcgattatgctgatttgctcctctatattgtctacacaggcattcagggaatccatattctgttttatctggtccattgtgtttttcatctcaagtaattctgtttgattcttctttatgatttcaatctcttttgtgaagtaactccagaactcggcttgtttctctatatttctctctacctcattgagttttttgattatagctgctctgaattcattatcacttagtttacctaattccaagtcctcaggacttaattctgtgtttttattgttttccttctggtctggggcttttataaattgctggatggtagaggagcggttttttctcatggtggtagaattcagttgcagttacagcctgtcaccactagatgggggtcgggagtggcgtgttagctctcagccttggggcaagatggctgcgcccactggctttgctgtgggggaggggctgttacacgtgccggtctgtgttcagatcagttctgttctctggtctcccaaggcccttgatttatagggtcccagcggacggaagctttctgccccgtcagcgggtctccactgaatcagtggcaggagtcctgtatgatcccccggtcgtgtggcccctccccctctccttcccgacccacgccgctacgattgcagactctaggggagggagagatgttctctcctaccgttctggcgcctccaaaggtgtaaagctaggtttatgatctcctccttcttggtactgtaggtctctaacgagctggcattatgtttattctctgaaattcagttcttccaatcttttgttgtattttggaggggagagaatcccgggtcagctcaccccaccattttgctctgcccaccattttgtctgtattttgaactcaaactctttccagattctcttgcacacttagaattgtatatgtagtttcattgcttaaaaatatattaattcctgtatctggctaataaaatggagtttgtagtatattaggcaagacatataaataaacatgtaaatggataagaagatatgtaacatcacgtagtgaaatagagtatgagggaaactaagcaagaacagggaaaatctaggtaaggcaatctggtctgaacccttttctgaggaggtgaatatttgagctgagacatggatggtaaagggcccaggtcgtttgcatatatgaggaggagtgttccaagtagagtaaacaagtgaaaaggcctggaaggaagcctgagcattgtgcgttccagagcagcaggtggctcagagcagggttactgaggggtgactaaaaaaccgtgaggtcagtgtgctaggagggaccagatcatgtaagggcttgtgattcactaagaagaattacaattgttttctaagattatttagtagccatggtctgattatatttttatatctttaattttcaaaaattaaacctttttgttaattgtgagaattatacagaagtctaggtaaaataaatatcgatttattagttatttgctttctctcatatacttttcatatattccttaatttttattaaaacaattttgttcgaatattaaactatttgagttcttatgacgtatttctaggttaatattctaaatttttttcttttatgtctcctttattcctgagctttatcacttcatttctgatttttttctaattttgatttatcttgttgtttcattacttgtagcattttcttaaagtcagaatactgaatattgttaagatggcaatactaccccaaatcccattggccaatttagaaaaattgacatcctggtaatgaaactcatgtagatatgcaagggatccagaatagcccaaaaatcttgaaaaagaaggaaggattcacactgtccaattacaaaacttaccgcacactgaaacttatagggtatattgaatgtgctgctaagtgggaagtttacacctgtaaacacctacattagaaagaaagatctcaagtcaacaacctaacttcatacctcaaggaattagaaaatgaagaatgaactaaagccaaagatagcagaataaaataataaagagtagagcaaagataaacaaaacagagaacagaaaagcaatagagataatcaatgaaactaagagttggtttctcaaaaatatcaaccaaagtgagaaaaatttacctagattgactaagcaaaaagagagaagactcaaataactaaaatcagaaatgaaaggagggactataaacaattttatgccaacaaatggggtaacctaggtgaaatcccgaaaacacacaacctgccaatactgaattatgaagaaatacaaaatctactcagtcttatactagtaaatagattgaggcagtaatcaaaaacctaacaaaaatagcccaggatccaatggcttcactggtgatactaaatatttaaagaattaacaccacttcctcgcaaactgttccaaaaaattgaagaggaagggacattcccaatgttattctatgaggccaacattaccatgataccaaagtcaaacacactacaggaagagaaaactacagatgaatattactgatgcgtattgaggcagaaattctcaacaaaataatagcaaaccaagttcaccagcacataaaaacgattctaaaccatgaccaaatgggatttatttctggaatgcgaggatggtgcaatatataaaaatcaagcaaagtaacacatcacattaacagaatgaagggaaaaaccagatgatcatctgaattgatgcagaaaaagcatttgacaagattcaatacgctttcatgacaaaaacactcaagaaactaggaatagaaggaaactacctcaacataatgaagggcaaatatgcaaagcccacagctaatatcatactcaatggtaaagactgaatgcactgtattt

SEQ ID NO: 60 - DNA, 57475 bp, Equus caballus
aagtacaacacaaactttgctattgcattgattataaaattttaatggaaacactctcttcttctacagctccctagtgaattttatatcttggaatttctgcctggaccaaatcctttcaaactgaaagtcaaagtaaaatccacacataactgagagtgcttatcatcttcgattgaatttgacataatatcctggtgagccagggctatcttttcacatttaattgattctttcttacagagtcaagattactcagagcatgtgctctggaacagtttattgtagaattgtttatctatttcatggcacaggcagtcattccacagccactgagttcatgctcttgggcctcatagataaccccgagcttcaagtcattctctactctctatttctactgactgacctagttactggtttgggtaatcttggtttgactgtactaagacaaatcagtcctcaacttcagacacccctgtgttttttctctttcatctggttgttgttgacttttttggtacttctgccatcatgccaaacactcttgtgaattctttatgtgaaattaaattgtgtgttattttatccaggtgccactcaactttgttgctttatcacatttttagtttgggaattattaatgttgtctaacatggcctgtgatcggtatgtggccatctgcaacactttactcaatctagttctcatgctcaggaatctgctcagatgatctctagctgtcacatttatggattcactgtgggactcatgcaagcagtggctaccttacacatgtctgtctgtgactcaaatgtgtcactagtcctactgtgatgatgtttccttgattgctttgtcctgttctgataccaagatcagagagctgaggtggttaatcatcgctgggtcctatgtgtttggttctcttatcattgttctcacattctatgtattcatcatatttgtcatcataggatcccctctgctgtgggatgagagaaagccttttctacctgtgcttcgcacctgttttctattactatatattatgggaccctcagttttacgtacctgagggcttgtgtgcagtccagatcaaaacactcactagataaagacaaatttgcctcagtattctatgtagtggtgatttgcatgctaaacccattcatctacagcttgaggaatcaagagctaaaaaaggctttgaaaaaattattgaaaaggtgtattctagtaatcaacaatgaattgtgtcattactaaagaaataaagaaatactggatacaggtttagttaggaaattctatttatttatttatttaaatcacttacatttcattttattattttctagaagaggcatttgctcctttataaaaaggaactaaggggagacagccaactgagggggttttaattggaagaagtcccctgctggaaacagtcctgagtgtttacctctgcctttcaggagggaagtctgaattttatcttggggatgtggtgagcatggggaactgtggtgagggtcttctggccttggtcaggtgacaacacaaatcatagtgccactcaggttccacagctgaggatggcttttgggatgccagatgtttggggagatggagggaacagagtaccccaaaaatacatactattcccatccacatctgaacaaatagactggaattattcaggttcaggtaacaaattttacctgttttatgggtgtaggtgtttttttaggttccctcatcagcggcacagaagaagatatgctgtggcatgcaccagttaatttccaccgtcctggctgatggacgttctgacagtgcctggtgctggcagatcgttccacattggcccacaaccattgcattcatttaagttaatttttattgagtttatgatagtttacaatcttgtggaatttcagttgtacattattgtttgccagttgttttgtaggtgcaccccttcaccctttgtgcccactccccaaccccctttcccatggtagccactaatgtgttctctttgtctacatgtttaacttcctcatatgagtggaatcataaagagattgtcttcctctatatggcttacttcacttaacataattccctcgaggtccaaccatgttgttgtgagtgggacaattttattctttcctatggctgagtagtattccattgtatatatatataccatatcttctttatccaatcctcagttgatgggcacttaggttgcaaccatctcatttttaaaaaccaacatcattctagttccttccttctccatcaccatcatatcctgagccatgggagtgggtgttttgcttgtgttttaaagttgccctcctttggatggatgatcatactttttagaaatttccctttggatctcccaagtaatttcatttaggcaaagataacaagagtttctggttttcgtgacatgtccacttgtctaaattcagctctcacaatctaggtgggcttgcttccaggttggtttgtgtgctgaggtggtagacacagccagcccctcattcccaccgtgagatggcatcgcaggaaaaagtctagggctgctccttccaatacccgtgtcatctcgtccctcacaagtactctaactctcaccctcatctagtaagccccattaggatgtttcttcttctcatggagaacttgcataattagtctctgcctttttcctagaaccaaatgacagtaatggttttctcaagccagtgccccacaattctcgattccctcagacacactcactactgtttgcccttaaattattgcatcatggtaaacatgtacagacggagagaaagagcacactttcaacagagaagtacagggggtcggggctaaagtgcaggcaaggcagaacagagctcaatcccccaggtcctaccagaatgtgaagatatccctatattgcagaataagttccctaactgtcagaatttgtccctgaagaaggttaaaccctaaacacctgcttcaaaaaaccaaaactaaataatcaggggaaaaaatacccctccaacaaaattaaagaaagaaagaaaaaaagaaaaggaaagagaagaaaacaaaaagaaactttaagcttaagcgcttaaaaattagaggcatagccttttctctcttttccatatgtatatgaaaataatccatgcttcatgctaaatacattatttaccctaaaggaaccttatttttgaatttaaaaaaatttacattttgtgatttttttttcctttttcaaaggaattcctgcattttggatcagaagtttctaacagctaaactgaatgtggaaatcattgatttttgccaagttgaagtctgactgacattaattgcaagctccattttgagggaagtataggagtctttccccctattttgtaatggtttaaattttccccatcaatgtgcctttaatcttttaaaaatataacacaatacaaatggtaggttccatagcactttgttttcgttttcatttggatcaaacaattttgacagacagaaaaagctgtgtatcattgtttccttccttcacagctcttataattctttgatcttgattttcacttgggcaacgaagaagacatagcatgttttctgtatcagttctctctctttctctctcccgtgtgtctgtgtgagcgtgtctgtgtgtgcagcgtcaaccttcaggcttatggcttgtagaacattttcttaatgtaatatagaacagaattcagtgattggcaacatcactaaaaactgacccagttccttctcatctgtcattaacacctggtgtgtatgactgggccagcatccacctcgtaagatgttattaggctgtgtggttaagaagaacaggggactggagatcaaccgcccatgcacagtgtgtggcaatgccatggttttcctggcactatttgatgctagggaccacaagcttgggtctgcttccagagggatgagggtgattccttcctgccaattgccttatacagagtcactcagtgaacccaactgggtgaacatcctgaccttttgaatctcggcattgggcctgatggatggttgctttgcacaagtgctttctgggtgctgagtgtgtatcccgtggcattaccgttgacatccctgcagactcagccacgtgcttctgacatgctgggggaagctatggtcattctgggtttttcagtcttgtcttcagatattgaaaagctttcataaaacagctgagtgtcaatataagttctatggcttcaatctcctttaaaaataaaattcttaagggtccaaaacaaaagaaggggcaagtttttttttaaaagtgatgaaaagaaaggaaaatcaaaccagataataataataataaatagctgatgttgccataaatcattagaaatcttctgccgtgctgaaaccaaatggctgtaagttgaaaacaaatcagtgacttcaatcttttgtggtttccttttgctctttgggccgctttgctgccctgatggtgaagttattcacacaggaacaaatccccaccaaatgcaggagtggccccgctccctctttcatctcctgtcatcactctcaggggcttctctgggcttctctttttgaggggcagcgtgtcactggggaccttccttgccttggttaagtactggtgcttcttgtcccgggatgcacagctgctgtcacgcaggacatcctcggtctccttggggctgtgtttcatgtcatcctcctctctcgctgtggcttttgggactctagaagcttccctcactgtcctcctggctccccttggtggcaaactaatagtggccatgggccgaagaggatgagactgtcactgggtggtgaggagctcccagcggtggaggatttggcactgctatagttgtgctcctccttggggtctccgctgaccacaggggagctgtaggatggctcgctctgagtccccatcgggcagctggtgagatcattcctcatggctgctgtcattccaatgggagtgactggcaatggccggactctgggaaacagccctcagctcagatgccacactgtttggtgtcactcctggaggaactcgcagacaggcttcggttctcttgaaggcactgccgggtgagttgagtgggcctgatgtgctttgatgcacccgaggagacagggaggtatattgaacactgtaagcttggctaataaggtgtcttttccaaagcctgagttagattttgtctatactggatccatgcaccacaatgccctttcccagtaccctgactcctctcattgcccactgtcctaaaacgcttattcaatgacaaattatgtctcactgatcttttccatccagcaggtgtgtttgcaaaatacagaaaatgttccaagatccatttgtggatacatttactggcaggtgcttggttgagagtttttgatggctgtaaatctgaggcctttaaagaacgggggggttgcagttggggttctgccaggcaagtgggacatgtccaagagcctgagggatggggtcctggaaggggctgggagtcctgggcagggctgacgctcttaaggacccgccccccacagctctcctgcagccagagcctgggggtcagctcttcatcctgcacagcccgctcctctaacctgatgtcaggcagagaaaagtcgaggtcattttttttctgaagggcgctggagaaagcgctgccttagtagcactgactcagcatgctggagacactaattctcaagctttctggcttcttactgggaggcaggactggatccgtttgtgtgaagtctcctggccagagggtggtgtggctcaccactgcccttcagtgcagacgtcacactttcctgagcgcccagcgagcatcacctggcggccctgctaaggacccccaggaaggtgtggtgagccaggcgggtgggcggcaggggcagcaggggaggggtggcggcagcagggcacctggcgccctcaagtggccctgccgcctcctgctcgcttcttccacagatcatcgggccagggcgcccagaagcgcaaaattgttccaaggcgggagttaggacatcaagtcacacgcagtggtacagagccagaagcataggcctctctgtcctctggggctcagtttcctgacgtctatttccttgaaaatcccttgaaaggattcctggaagatgctttgacttacacagagtaggaatttcaatgtttgatagttgaattattaaaaaagaggtaaagatcattccttctctttgaaggtgagctgcttcagcaataaagatgaagaataaagcaccgtaaaatcataagtttatctcctttcactatgatattgagaattttaagctgtcttgaaagacaatacaaatactattgcaaatatcaggtaatattttctttcattgttgaactgagggaaaatatgctccgttaaagggttttggctggaaaatgcctgaaaaatgaccttactctcacttgacaatgtccctgttgatattgttgaacatttttttaagacatacttttagagcagatttaggtttacagcaaaattgagagggaggtacagagatttctcatacctgccggctgactcacacacatggctggcccattatcaacatcactccccagagtggtacatttgttaccatggatgtacttacattgacacataattacccaaagtccatagtttcttagggttcattcttggtgtaatacattctatggatttcgaaaactgtgtaatgacgtgtttattattgtaatcttatacagagtattttcactgccctaaaaattctctgtgctctctctattcatcccttccccaccaccccgacccctggcagtgactgatcttttcattacctccatggttttgtcttttccagaatgtcatagagttgtaatcatacagtatgtagccctttcagattggcttctttcacttagcaatatgcacttaaggttattctgtgtctttttctggtttgataactcatttctttttagctctgactaatattccattgtctggatataccagagtttatccattcacctactgaaggatgtcttggttggttccatgcttggacaattttaaataaatgtgttataaacattcgagtgaaagtttttgtgtggacataagttttcaactcccttcgttaaatacaaggggggcacaattgttgtattgtatggtaagagtgtgtttagttttgtaagaagccaccaaattgtctgggctgaacatgtgaatatgatgattcaagcattaccccttctagatttccgtcacattcagccagcacttaactctgctgattatttccgggtgggtagagtgacacaaactttattctacattgttactaagaatgtaattgccctgcttttgttagtttctagtttttacagttgcccattgacagtgacattatcactgggcatggaagttataaagatgccctgtgatttcctgtgttccagacattcatttcctggccccattttgcattggcacccctaacttcctctgttaatcatagtttattcccttagccagcacgctaatgccttccttgtctgatggtccactggcattaagtagtcacagattccagtttgttaaaacattaattgagaccctctggaaagatttgccttccggaagcctaaaactgtaacccagaggagcctaatattgtaggaataggaggcacaaattcagaaaatgggtcacagagtgtaatgatgacaagggccaatcctactacaacttcttcatttccagacccatgatttcatgctcttggagacactatattgcctataacctacaccgccactggtttgtaacctacagtgaatcatggaggattgtgctccagtgcaagtccttttctgagctggtgacttagatgagctgtcaatattccatttggatctcctatcaagccagctgatggttggtgatgagatacatattaagatcattcattctatgccatggtcatgccaaaccttcattgctgtaaaatgtatttcttcttttcaagagacattgtgcggtttactatctaagaaataatgtatcctttaagctgtaggaaggtgatattccctcagacagtgcaggttgggaagggaaatgcctattccacctattgatttctgtaaggacaaattgcgtccctccaatattgaagtgatctgatacaatcggattatcactgtatttctggcttgtctttcaaaaattggtgccatatgtaggacttggcataggtctctgcttctaacagatgggacactcagtgtcgatactagtagaaggaggctatgttattggatacatacacatataggcttcattcctgccactgtggctactctgtccatggtgtcacggcatgagccctgggattgcaagagtagagagggtggctgctatctatccaatagcttctccggtcctcctcactgtcgcaaaccttttctgctacagttaccctttagtagttgaaaataaaatcaacatgttttgtgcccactcgtacatcacctaaaatcctctgccccagaatgccacatccttggagacttgctactcccagtcccctaaccaaatttccagcgtgacttatcactgtgaatagtgaatgaatgaatcagtgtacagtcatgtgtcacttaatgatgggggctcattctgagaaacgtatcatcattgtgcaaatgtcatagagtatacttacacaaatctagatgctataacctactacacacctaaactatttggtactaatgttttgggaccaccatcatatatgcggtccatcactgaccaaaatatcattatgcgatgcatgactgtatccctcagaccaaattttctccatgggaattggaaggtcaaatgttatttgcactgggacaatttgctttcatcactgtcctccagtgtcacctcttagtgggactttaatgtggcacaagtccatttctgatacgtcctgcataagggggtaactcttctttgcactaggcctaaatcttaaatggaattcttcagttggaacatctactccatgaaaccacatcatggactgatggaaaggagtctgtgcagcagggataagtgatataaaaatctggactacttgttcccataatttgttagtgccattacaacccccagtttgtaaatcagtcatttacacttacaatggattgctattgtgccagctcaaaatgatgtgttggtagatcctataacactcaacacatgataggtagctgatgctgaattttcatttggtgtcttttcatccagcacttagtttctactggggtgcagtagaacacagaaaactattttatttcttcctcaggaggtctcgctccatggtcaatgtagtgatgtggatttggtctttccaaagactcacacatcattcttttccaatacaggtatctctagcatcatcggatcacttgcagaatctactttttctctgaaactgcatcaagttaggcagactgctgaaatacccaataaatggctcagagctatagtgccaagcatggtatatgctgcctggcaagcccaaagtgttctcaaaagtgccacacatatttctgagttgtagtgaacttgttgcacaacaatgtgtcttttactttggaggggatgtgcaaaccgtcccacttgtcacttgactttaaagcaaatggacagaggtagccattggactcacaataattgcgggatttttcttcccagcttttggctcctacatgttactaaggcaccaaggaatcttgccactcccagttcatcagtacagttagcaagagtctattactgtgcttcactcgcataatgttttgtgaaatatccagatgattaaagctcctatcgtcaaaatttattttatctttcttgaggtataattgaccaaaaaaaacaaactgtatatatttagtgtatgtgacttgatgttttgatatatgtatacattgtgaattaatggccacaatcaagctaatgaatatattcatcacctcacataattaccatttttctttccttctttcattccttctttctttccttccttctttctttctttcttttgctcgagctctctctctctccctccctgcctcccttccttccttccttctttccgtccttttattgccgagaacacttaagatacacctctttagcaaatttcatgaataatacacagtactgttaactatagttgactgcacattatatctccagaatttattcatcttgcataactaaaaatttgtatcccttgacaaacatttccttatttactcgtcccctcttgagcctctggcaaccattctagtctcttctactaagagtttgacttttttagattccacatacaagtgagattatgcagtgtttgtctttctatgcctggcttatttcacttagcataacgtcttcctggttcacggacaaattttggaagtcaaggattcacatatccctgaggaagtctgctataatttatttattttctctttttcatcaggggaactaagggtaaggagattacttaacatatagagtaaaacatttcatgtcaaattagggatacaatttttctaagagttttacttaggttagactgttaattattgttagattaaaaaaaaaacctttctctttataagaaagtggcaagttggtccctatcactgaatatgattattataaagcagttaagctttattgatccatattaccatacagattattctcaagataaataattatagtaagcttgtgtggtgggcattatccccactttataaatagctgaatcttaaagaggataagtgacccattcaagaacacatagcttgtatgtggcaaagatatgatgtaggggcaaatgcttctgaattcaaaattcatgtgctttaatactctcagacattgactaacgattcaatgtatcattgaatttttgtttgtttgtttttatttaaatatcttggggcagattcaagaagataatggttgtggtagattactaccaaataacccaaaagaatttctctgtctatagccacacacttttatagttacctcccttatgaactctggtcccatgccttgctttatataacagaatgttcaaaattgatgtgtacaacttctaaggctagactctttttttctccatggggatgctaaatgttggaagctaaccaccaagtttttggaagaccaagctaggcacatggaaacagcacatggataagagaaagcactccagctgacagccttatcagctgtcagtcatgtgattgagattgccttggatcctacaactgtcctactgccccaggtgccaccacatggatgaggattgcctagttagcccacagcagcatgaaagctaataactcattgctgctttaggacactaagttttagggtgggtttttatgtattgcaatagatagttgaaacaatagtgatcacagaataaattgcaatttattttaaaagttaaattagctctaagaagaaatcctgaaaacagcttttacaattttgacacaaggaagaagtttaaaatagttttctaaaacaattgatgcacatattctcagaggcacatagctgtctgcatgttgatagatgtttttcaagctttcttgaatttctttcaagcctttgaggaaaatcacacacttagcgtaattgttacagattagctacaaataaaaatacaaaaaatatatggaggcttctatgcaatttatgtttaacattttttgttacaattgttttaattctgctaggcagaatgatattataaaaattaagaacagcattcacaggataaaatgcccacattgagtaaaagttaattacttgttcttttttaaatgagcaactgtttgtgatttttaaaatctatatatctttctattcatcactatatacatacatgcatgtagaatggggataaacagagtttgttggagagtctgaagagaacgagggttaatttctctgtgatttgcatgcctttaaatcctttccaagagaattcagggaacaacataaagttcattttaaatcatgttcctctttgaacagaacttttaagcaattttctaagattgaaataaatgtacctccaggttgataagaaattcatagtttaattattatttgcttacagctcgacagaatattgagtttcagatgcagggttggatctttggtgcaatttatcaatacttggtagccttgcaaagtctgatgcatactgtgacctcttactaaaattcaaaatttaataaaatccatactaaattataaaaagtaaataaaaatagttaaacatattttcagttgttttcccatgttttaaaacatctttgctgttagatattaattctttattatacttgggttcagtagagtgatctgaaatttcgagtgattcctctttgcctgttaagctaattgggtcccaaaagattaaccataacataattgttcatgcttgtgagacatcattacctttgttttgttcagcaaatgcttaaaatgatgtaacaaggaaaaatgtttcaaggagaccaaggcatgttatgtaatgttatgcattgttgccattcccagtgtttgcctcaagatttcttggactcttttgggttacgttgttgattactcaaaggcagcacgtggtaggaaaaaatcaaggtaattgaggtagcaaaaaagagtttgaagtaatacaaactttgtatttatttgttatatttggagcatctactaattgctgagtcttacttgtttcaaatggagaagcgcaaagtgtcgtgacctggagagaagtaggttctcaagaagaagccaagtttcagttggaggaaaggataataaatgattgaagatactggagagtttgctgatatcagaggaagagctacacaggctccaatacatcagagaaatataggcactacaaaggataagagcccagagaggcattgatttcagatcacaagttagtgaggcagtggaagaacacttcaaaatattgcagagaataacctcctacagtcatcagtatgatggcgtacacacaagtttctgcagagtaagcctcagtctaaatactattaatactattgagagctaaaattgacttatttagcacaaagtgtaagataggcaacattctacacactttatatggacaaactcatagattgcctttccaaaattgccttgatcgctggtgaatgggaaagttcttgctccctgaaaggtgagcatttccataaactatgaattgaggttagagaatcaagggctagtttaatgaattattctgcttcaccccaccctaatcatgaagcaagaggagggcttaagctctcaccctcagtttccatatctgaaagtgaagatgatagctatattgccaaccaatagggctgatgtacagataatctgggataaaaatctgggatacatagtgtaaatataaaatcaaatttatctcttttctgctcaaataaagatcattgaaagctactctcatttgattagccagaaacccctttgtatttctccaaactcatcctagaattttttttcttctcctgctttgcatttggatatttcaacgttcatgataaatgtattttctgaatcacttaatgtattttaatcctgttatgcctgtttccaaaaaagcaagactatacacattcctaagggttttttcctccttttaattaaaaaaaaactacataacaattggaggaaaaataagaatcaaagtaagtgagggaaaatattgaataaatgtcatcctgaatatttgatatagagatcatcagtattcaaaattttgtttatgaccccatattacttcttctgaaagaaattttttaatttattgtttcttcttaattaaaatttttcagaggaattgttataatttttaaagtattccaacaatttaaaacattatttttatctgtgttcaaataactcttaatctttatttttcttaataaaaattgatacggaatggattattcaataatataaaattttagacaaaataccatttttctatctttataaatctccacagaatttcatgctttggatttcgtgcctagagcaaatcacttcattctgaaaccagaagtaacatgaagattcttctttgcttgtgttcaacataaaatcctggtgtgtcagaaccagctcctaacatcttcttgattattgccagtggagacaagaacactcagaatgtgtgctctggagggtcttaaaatattttaaaaaacacgttcaaatctgttccacagcccaaggcaaccattcagcagtgtctaagtttatacttttgggactcacaaatgatccagagcttcaagccttctctctggtgtattcctagtgatctatttagctagtgccatggataatcttggtttgattgtgctaatccaaatcagaccttggcttcacacacccatgtatttgttttttctgaaccctctggcctctgttgatttttcttttacttcatctgccacccaaatcatcttggtgaattttccgtgtgaaggtaaatgtatacaattttattcgtgtgccattcaggtgctctgcttcatcacatttgcagttggtgaaatgtgtttgcttgcaatcatggcatacgatcagtatgttgtcatctgcaaccctttactctatgtcattctcgtgcctagaatattctgttatggaatgattgttggcacatatatttatggattcactatgggtcttgtccagacagtggcagcatcccacttgtctttttgtggctcctgtagtcaaccactgctactgtgatgatgttcccttgattactttagcctgttgtgacactcatatcaaagagcagatgttattaatgattgctgtgttcgttgcactttgctctctactgattgtgataatttcttaagtcttcatccattttgctattctgaggatccattttgctgaagaaagatagaaagctttttctacctgtacttctcacctgacctgcatcacaatattttaaacaacaatcatttttatgcacctactgcccaattcaagccattgtctgaacataaataaatgtgtttctgtgtagtgatccccatgtgaaatccattgatctataatttgagaaatcaggaagtaaaatttgcatttaaaagaattaaagaatagttgtgtttggatatcaaataactgaaaacttattggacagggagagatcaggggactttgagttgtctcttatctagaatcacaatgctcagaaatgacagagcccaattcctcactttgggtgctcatgttcactcaagaatgtctcaccagctttttcattctcagtgatttccacatgaaagacctgttttatactatgagttgttgaattgtaaaagaggagagagagagagatctgaatcccgtttgaccacaacttcttcttcataattaaagaaacagagaattgggaaatagaggctttacctgaattctgagccatattgagaaatttgggtagtactgaaatagatcaacataatagatcaacatctggtaccttgtatttatttcattggagccatttcacaacattataattcactgcccattctacataagtatggtttaggaacatgggctcttcattcacacagtttggctaacaattttagcttttccacataatagctattgtcattagtaaattatttcacatttctgtctcttggtttcctcctcagcagaaggcaataatagtttctttctcttggcctcattgtgagtattaaataatattataaatatcaaagacactgttcctagcatagggcaagtacttcagaaatgttgactattacacttaattattaacattatttttggatccatggtctctctaatttggcttcaggcgatggagtaatagccttttagaaacagttggcagcacgatgtgtttcattttaaatcaataaaatgaaaatacaaagctaaggagtcattttactgtgatttttaaatcaataagttcttttcaatttatttgtgggtgtgcctatgatcatattttaaactgaatcttttttagggtctgcattactgctattaaaataatcatcttttggtgatgtcaggaaatggaggagtaagctgttccttttatctctccctcttttgatctacaactaaatggacagtcactgaccaatggaggaagcccacacagcacaagaggatgcttgacagacacacagctatatatctgagggtggctagactgacaccccccagcaagtggcagagaagaatgagaacttccgtctctcccctggtagctctatgcacacacatgaatgcttcccagtctggtgaaagtgccccaaacgtgaggacatgcaccaggttgcatgtaggaggaggtgatggcagcccttagcctgctcatgattgcttccccagtggggaagaggagcccaccaagaacaatccactcaagagctttaatgcatccaaggctggcgaaagtgcccattgtacccccacggcttccagcagacagggttggggcagaactctgctcctgcttccacctagaagtaacaggtcgaatatgcaacctaacactaccacacatgtcccaacaaaagattggttcataaaacaccatgagaaactacagcaaaaattcatacctgaaggaaaggacaattctccaaaacccaatcttgaagacacagaaatttacaaactaaatgacagaaaattcaaaatagctgtcataaggaaactcaatgatttacaagagagcatggaaagacaattcaatgagctcaggaataaaatgaatctctgcaccaaagagactgaaacaataaaaaaaataagcggaaattctggatatgaaaagcacaattaatcaaataaaagataatttagaatccttaagtaatagagctgatgttatggaggaagaattaataattacgaggataaaaatgtagaaagtctacagatggtgaggtgacagaacaaagatttttaaaaaatgaaagaattcttcaagaaatatctcactcaattaggaaaagaaacataaagattataggtattcaaaagggggaagtgaggcagaaatgagcagatagcttgttcaaagaaataatagctgagaacttcccaaacctgggtatggtccagatttacagataaatgaagctaatagaatgcctggttacatcaatgataaaagaccttttccaaggcatataatagtaaaaattgcaaaagtcagtgacaaagaaaaagtataaagagcagcaaggaagaggaaaataaactacgaagggaatcccatcaggctttcagtagaaaccctacgaactaggagagaatggaatgacatattcaaaataatgaaagacacaaactttgaggtaagaatactgtatccagtgaaagtttccttcagacacaatggagaaataaaagctttctcagataaacagaagctgagagagttcattgccactagacctcccctacaagaaataacaaagatgccctcataatggaaacaaaaaggcaaaagtttacaaagctctgagaaaggagataaatagacagacataatcagaaaacttcagctctctatcagaacacagaggcaaagactcaattacaacttataaaggaaaagaaagcaacaaaattaattataaacacctcaacttagtcacaaactcacattaaaaacagaatatttttaacaacaataactcagaaggagagaggaaaaggaaggaatctgtttaggttaatggagataagaggctatgagaaaatggactatttcatctatgaggtattttatgcaaacctcatggtaaccactaaacaaaaaatcagcagagtcacaattcacaaaaagagagaaaagtgataaaacatcctcagaaagcaaccaaaatgaaatgacagtcagaaatacaaagaaagagacacaatggaaacctagaacaaccagagaacaagagataaaaagacaatattaagccctcatatatcagtatcactctaaatgtaaatggattgaattctccaatcaaaaggcacaaagtagaaagatgtattaaaaaacaagatccagcaatatgctacctccaggaaagatttctcagctctagagacaaacacaggcttagagtgaagggatggaagacgatactcaaattaatggcaaacaaaagaaagcaggtgttgtcatacttatatcagaaaatgcagacttcaaattaaaaagaggggcagtatataatgataaaatggacttttcacctagaccatataacacattgatatatatatatatatatgcacctaacacaagctcagcatagtacataaagcaattattaacagacttaaagggagaaattaagagcaacacaatattagtagggggcctaaacaccacttacatcaatggacagatcacccagacaaaaagtcaacagggaaataggacatttaaacgaaactcttgatcagaagcacttaaaagatatattgagagcattccgtccaaacacagcagaatacacattcttctcaagtacacatggataattctcaaagatacaccatatgttgggaaacaaggcaagcctcaataaatttagaagattgaaatcataccaaccatgttttctgaccacagtgctatgaaactagaaaccaactacaagaaaaaaactgggaaagtcagaaacatatggagactaaacaacatgctaccgaacaaccattggatcaatgaagaaatcaaagaggaaattaaaaaatacctgaagacaaatgaaaatgaaaatacaatactaactcttataggatgcagcaaaagtggacataagagggaaattcataccaatacaggtccacctcaacaaggaagaaaaatctcaaataagtcatcagaaaatgcacctcacagaactagaaaaagaagaaaaaacaaagcccaaagtcagcacaaggaggaaataaaaattagagcagaagtaaaatagagactaaaaaaagtagaaaggattaatgaaagtaagagctggttctttgagaagacaaacaaaattgacaaacccttagccagactcactaagaaaaaaagagaggtctcaattaaataaaactagaaatgaaaggggagaaattacaacagatattacagaaatacaaaagattataagggaataatatgaaaaactatgtgcccgcaaattgtataatctagaagaaatggataaattcttagactctttcaaactccccaaactgaatcaagaagaaatagagaaactgaatagaccaatcataagagattgaaagggtaatgaaagacttcccaaacaacaaaggaccaggagcatatgacttatctggagaattctaccaaacattcaaagaagatttaatacctaggcttctcaaactattccaaaaaatggaagaagatcgaatgcttcctaactcattttatgatgccaacattaccctgaggcctaaaccagacaaggacaacacaaagaaggaaaattacaggctgatattgctgatgaacacagatgcaaaaatcctcaacaaaatatattaaaaggatcatacaccatgctcaagtgggatttattccgaggaggcagggatggttcatcatcttcaaatcaatcaatttgatacatcacataaagaaaataaggaaacagaatcccttgatcatctcaatagatgcagagaaagcatttcactacatccaacatccatttatgataaaattctcaacaaaacgggtatagaaagaaagtatctcagcataataaaggccatatacaacaacccacaggtaacatcatgcttaatggtgaataagtaaaagccatccctctgagaacaggaacaagacaagtgtgcccactctcaacacttgtattcaacatagtactggagctttttgccagagcaattagacaagaaaaagaaataaaaagaatccatattggaaaggaagaagtgaaactctcactgtttgcagatgacatgattctatatatagaaaaccctaaagaatacaccagaaaactgttagaaataaccaacaactacagcaaagtttcaaggtacaaaaccgatttgaaaacaccagttgcatttctatacactaacaatgaagtagcagaaagagaaatcaagaattaaattccatttacaatcacaacaaaaaggataaaatatctaggaatacacttaaccaaagaggtgaaagtcctgttcactgaaaactatgacattattcaaagaaattgaagaagatataaagaaatggaaagatattccatgctcatgggtcagaagaataaacatagttaaattgttcatactacctaaagcaatctacaggttcaatgcaatccctatcagaatcaaaacagaatggcattcttcacagaaatagaatgaaggttaaagattcctcaaatttatgtggaacagcagaagaccccaaatagccatggcaatcctgagaaaaaagaacaaagctggaggcatcacaatccctgacttcaaaatatactacaaacctatagtaatcaaaacagcatggtactctcacaaaaacagacagatggatcagtggaacaatgaaagcccagaaataaaaccacacatctgtggacacttaatcttcaacaatggagccaagaacatacactggggaaaaagaaaagtctattcaacaaacaggtgttgggaaaactgggcaggcacatgcaacagaatgaaagtaaaccattatcttggaccacacacaaaaattaactcaaaatagattaaagatttgaatgtaagagctgaaattgtaaaactcctagaagaaaatatagatagtacattttttgagattggtcttagcaacatcttttcaaataccatgtctacttgtgcaagggaaacaaaagaaaaacgtagcaaatgggattagatcacaataaaaagcttctgcaaaggaaaggaaaccatgaacaaaatgaaaagacaacccaccatctgggagaaaatatttgcaaatcatttatctgacaagggattgatctccaaaatatataaagaactcaaacaactaaacaataacaaaaaaacacctgatcaatgaatgagtagaggatatgtacagacatttttccaaagaagatgtacagatagccaacagacacatgaaatgatgttcaatatcactaattattagggcaatgcaaatcaaaaatacactgagatatcaccttacacaagtcagaatggctacaattaccaagaaaaaaacaaatgttggagaggatgtggagaaaagggaaccctcatacactactggtgggaataaagactggtgcagccactatggaaaacagtatggagatttccaaaaaaattacaagtagaaataccatatgattcagctatcctgctactgggtatttatccttgaaatcaatgatacaacgagatttatgcacccctatgttcattgcagcatcacaatatccaagatgtagaagcaacccaagtacccttgtctgtatatatatatatatatatatatatatatatatatgtgtctgtatatatatatatacacatacttacaatggaatattactcagccttaaagaaagacaaaatcattccatttgcaacaacgtgagtggaccttggtggtataatgttaagtgaaataacccagagaaggacaaatactgcatgatttaactcatttgtggaagataaatatatagataaagacaacacattagtggttatgaggggaagggggttgggggctgggctaaagtgataaaggggcacatatctatggtcatgaacaaaattagactactagacaaaaattagatcacaatgaagtgtattcagaaattgataaataataatggacacccaaaactacacaacggtataaaccatcatgatctcaataaaattagtagaaaacagcaacttttttcttgaaaaaagaagccacttttattacatttagtaaagactacattaataaattatgaacttatttagttctaaacttttcagagtaaaaatagaaccaacatctattgattctttttccgtatgtcaggttctgtgtgatatgctttaaatggactgtctctattaatttttgtaacactctactgagatgtatatttaaagaataaagaaattcaaaacagtttacacaattcattaacacacctgcagctgataactggaataaaacaagatttgtgttccattttgtccaacaatacagcttgattttctaatgactatatgtccaactatacaagttatacaacagtgggatgaaaagaaaactgaacagtgattcataaaaatgtctccccaaaactagattgaaattaaatttatcataagttaaaaaaatgattaggggctatctgtagttaagttctcacactccactttgccaacctggggctcactagttgagattctgggcatggacctaaacatcactcatgaagccatgctgatgtggtgtcccacatagaagaactagaaggatctacaactatttactggggcttttgggagaaaaaaagaagaagattggtagtagatactggctcagggctaatcttcttcaccaaaaaatcaaatcaaataaaaatttttttaaaaaattagaaagatatgtgagcctgaacctagcacagaaaatggatcctccatattcctcacagtctggaaagaaggtaaagggaaaagtcaccacacatggggcagaggaccttctgcttttatcatccctttgtctatcagtgaccttaacttcaaatgtttctgagtatctcccatctccccccaaatccagactcttagctgtttcagtaaagcctaaccatattttactttgacactttggtgtcacaggtcccatttgctatcacagtcatgtgtcacttaacaatgaagatattttgtgagaaatgcatcattaggtgactttgtcactgtgtgaacatcatagaatgaactgacaaacctagatggtatagtctactgcatccctgggctacatggtactgatcctatgggaccagcatcgtacgtgcagtctgtccttgaccaaaatgttgttatgcagtgcgtgactgtatatgactgcctaggtttaggacctgaggaaaggaccttaacacacacacacacacacacacacttttctcatctataaatggaaactttccagagaaatgatctctaagggtcctcaacctgtgtggttactttcataataagataccaacattctatgcttaattccttaagactaaattaagtaccaagaagaaggcccgtgggaaaaaatctatcaatgtgtaatcactagtggtccttcttcatattttactttctgttattgttttgatgacttcaaaatatgtagagcaatatgacctcctctggactaacagagaaatgagaaatatcattgagagaatatggaggaaacataagtaagcatacaaaaaagtaaaattaaattcatcagaatgcttacattctagatattactgaaaatcttatatctaaaacaattgattttttaattaaattaaagcatgttttcatatacaagcatcaaattaatggaagaaaaaaaagttgaccaggcagttgcatgttgaggtggagtttcgatttcaaaattgaataaacttaaaaatcatatagagacaaaattacctctgaaagtctgtgaaagtgctcatgaaatacagcactcatgattttgcatatagcttatagacctctagaatatgttatcaattcctctaattgatttaaagcaatttttcttcataggctccaattagtttctgtaggttgttctgaggcatcaccatcccacagtatcaccatttattcagtcatttccacacctctgtcaattttgaatgaaaatccttaaaatcactgacacattttacccaaagatttccttaataagcactgctgtttcctgtttcacttcgtctttcctaatgtgagttttgtctcaaatttaactgcacattgaatcatccatggagtttttaacatcccaatgcccaggcaccccctgctagatttatcagaatgtctgggtggcacccaggcttcagtatttttaaagttccccaggaggttccaatgtacaccatatttgagaaccaggagtctacagaacaaattcaatggttagaatgacaagcatagctcagccatactttcaaacttatttatttctattttacttttgtttgcctaccctccagctgtattagttgagtacatgacttcaccatgccagtgcaattcaaattggagtatgcctgttcatgttgatatgaaaagactcaccaagtgttatgagggcaagaatagttttaagaaaattaatgttcagttcttccatttccatatccattccttcctgaaaatgatttgcctgagagagcacctatgctcttgttttgtttttgggtttttttggcttctattttcaatatccaccattctttcactttacaaatgaaaatatttctcacccatctggaagattatgattccttgctccaagatgtaaaaacattcagtgttctaagtaatttgggcatttatataattcctttcatcgagacactctcatgtcataatacgacaaatggcaaaggaaagttaaatgtatatttaatgcttattcatcaaaactgtgattataactcaaacagaaatattttactagtatggtataaagaatctatagaactttatagttccaagaataaaattcaaagctgtgtgtgggtgtgtgtgtattctaggagattacctggttaattcaatatgaggtcatttaagaagtgcatatgtgtaagagagagagaattggaggcgggtgaagtagaattttaagtacagatagatatcctttcgaaagtactgaaaagcagagtatgaaagtaagaaatgcagtcaggatgttagcagtgttatcactaaaagcagactgcatttaataccacagcttaccgaggaaaccggtttctaacacgaaccttgcttatgggtggagggtttgctacgcactctgtatacagcctccacatggctcacctgcttagcaatgatcctagctcccactggatcactctcaagttctttgggtgatttattggttctagatccttttggacccctagagatatcttgacttgaacctctagagacatctgaaagctgtaatatttccttcccggtttctctcaaagtaagatgagctggacaaattatattgcaggttttaaaaaatattttaattatatgccagaaaaaaagcataattccagtgtaccattcagataatttgcatgagagcagagataggctagactactggaaataacataaagagaccatacaccttggttcttttgcctaagaactcaagtttctcgaaaggataagaccagcaattaaattctgagttatttactcaagagagctttctcaatatgcatattctttttaattctcaatttcttcacttgtgaaatcaagtaaaaatggtacatctttcatggttttgtgagtattgaatgaattaatgtacataaaggacttggtaaactctatggtatgtgttcaaaagatatttgcttaaaaagttagataaattagaactataaataaaatcaagatacttcaaaaacctacctgaaaaacagagcttcttctgtcacagtttcagattctatcttggtgaatctacacaagaaatggatgtgtaattattagtggtgaaacccagtctcttcataagtttcaaagagtagatatgagtgtgtgtgtgtaaaacacaactcacagaagtagccaaaattcttgaaaaagctgtcgactgcttccaatttctcataaactttacctttccaatccaacttttccctccaccatggaagccactcctttctagcttatctgactatcatactatggataagtacagtgaatatttttcaagtattagttggatttcctctgaaatttgaaaatgttgtacatggtctgtccttgtcatttgtgatactacactttatttttttctttcttaattgtagtaagaacacttaatgtgagatctcccttttaacaaattttttagtgcacaatacagacgaaatgtacagcagatctctagaactgtttatctctatagatctctctatttgtatctatctctctatctatatatctccctatagatctctagactgttttagatacctcatataagtggaatcatgccatatttgtacttctatgactggcctatttcactttgcacaatgtcctgcaggttcatccattttgtcacatgtggcagaatttccttttttaagcctgaatgatattctactgtatgcatacacattttgtacgtatatttatatttgtatatatgtatatttgtatatatacatatatgtatgtatgtatgtatgtatgtatattttcttggtccattcatccattggtggacatttccattgtttccatttcttagcgactgtgagtaattctgcaatgagcaggggagagcagatgtcttttacagactctgatttccattattttgggtagatgcccagaagtgggattgctgaaccatatggtggctttagttttaattttttgaggaaccttcatactgttttccatagtggctgccccactttatatttccactaaccatgtacaagtgttccaatttctctgcctcctcgccaacatatctttttttaaatatgtgtaaataatagacatcctaactggtgtgacgtaataacaaaatagtgggtttgatttgcattttcctgataactagtgacgttgaccatgttttcatatatctgttggccatttgtagtcttctttggaaaaatgtctattcaagtacttagcctgctttgtaattgggtcatttatttattttgactattgaattgcaggagtccattatatgttttggaactaaccccttatcagacatatggtttcaagtattttctcccattctcttagctacctttctctctgttgattgttttccttgctgtgcagaagcttttcaggttgatatagtccaatgtgtctaactttgatgtcgtttcgtgtacttttgatataatatccgcaaatcattgccaagcccaatgccatgaagattttcctctgtgttttcttttaggaattttatagttccaggtcttacatttaagtctaaaatccattttgaggttatttctgagtagagtataagataagagtttaatcttattattctgcatatgggttgctttagccattagagtcctttgtagttccatatggatcttaggattgtaaaaaaatgtcattgggattttgctggggattacattttcttttttatctcttgcctcactgatttcagtttccaggctttactttttttctgttattatttttggttcttctcgccattccatatccttttttatgctcacaagttcaatgatcaatgaatctcaaatttatttctcacattccatacaatagcaggattctgcatgacctctcccaagttttcctctctagccctgccttgccctctctttctaaaccacttttgttttaaccacattccttttatgtcatctgcttgtttgtttcttcctgccacaaaactcagtattttgttctttctttcttaaatgctgtccctacctcccatcccttttgtcaaactttacttgagaatttaaactaagtatcattttctaagggatgttttactgaaacttgaactatgttgggttcctctatatattctaatcatcacgtacctctacctagaaggaaggatcagagttcatgatcataggctcccttgtgtagctattttaactatctctcccaacagattgtaagctccatgagacagagatcatgcctatctcgttcagttcctgaatttaaaatacaaaaacatattaaataaatatctgttaaataaataaactcgtatacaatttaccaagtactctgaaaaatatgttatgagcacgcacaaacacaacctatcatcagatggcaaaaattgtgttataacccttgctttcaacttcccaaggtcttacagctacttatttgcatcacccccaagctagacattcagggtcatgcagctcaacatgatcaattaaacagatgtggagaggtaggctcctcaaccttatataatttcctctctcactttccagctgagtgaagaaaagagcatcagagtatttaataacaataatatccacaaatgtttatttagggtcattcatattgtgccaggcacactcctagcattctatttattagcacatttaaccctcataacaatcttgtggtataagtactttcattattgctatttacaaaggagtaaactgaaagacagggagatccggcaccttgctcaaggtcacacactgagttaagtggaggggccatgtttcgactcagtccagagacataatcactaattcacatttctcatccctgttctgctccaagcatgggcatactgactgcatctcaaagtcatgcttgatggctaaagccagttgaatgcagccaggaagaagttgtgacagaagaccagatggtgctgggagagggagtgttctttgtccctgctcctgctcgctccttgctttggcatcatgtctctggcagtagatgtgtcactctacccggctccatccaggcagcctctcatccatagccctgctctcattggggtcttaattttctctatgtccctcaagaccttcggatgatgatcagattgcactgctgttaaattctaagtgcctcactatttcttggttgttcatgtctcttcatttgaattatgtggatagattctcacaaatataaccaataattctttaactccattgcaattcacccctctttttcttgtttggaacatgtttggaattcattagaaagaaagatcacctgtatgtatttaagtgagggtggttgcattccaagacctttgaaaatatgaaacacttaagtcagtacttaaaggatggccaagatttctattcttagaaatgaggaaatgctctgcaaggtgtatggatctttactatctatgtaaaatagtaactgtttacatttcattcacgtgatcaaaattatatgtttgaagtgaaatatgtgtggatgtgaggaagggaaaacatctcttgtcaactgtctgctgggatctcatctggactaaaagctaagctgtagaattctgttatagaatattagaaatttcacaaaatatcaacacgagagaactttacttggcagtggtgatgaagcaagacaaaaacaggatcactcagtaccaatgtcagagcagagacaaaatcaagaacactgtctaaaccatgatgaaatccagccttttgtgacaacatggatggaccttgagggtattatgctgagagaaataagtcagagggagaaagtcaaatacaatatgatctcactcataagtggaagataaaaacaacgacaaacaaacacatagcattggagattggattggtggttaccataggggaaggggtaggagggagggcaaaaggggtgattaagctcacatgtgaggggatggactataattagttttcgggtggtgaacatgatgttatctacacagaatttgaaatatattatgatgtacatctgaaaagaaacacataaattaattcaattaaaaaaatggccaaacatccttttcacctggctaatatgaaggacaatgcttcctcaccaattaaagcttcagctctcctccaatttgtctacattctacatgagaactattaaggttctgaatcataaaaatgataccactgtctgaaaccacccccatctagagtgcatccatgctttgttgaacactaccctaataaacacacaggtggaaatcctgtagcaagcctggtcctaagacctctcactgagatgcttctgttttccgtggttgacaatctcccttgttgaaacaagcaaccataacacaactttgactagagatttgtttctggtggtctttgcctggacaggagcaatgaaagaaatgatgcgaagtctgcaatttacttcaaaataactctgagctccgtgggtggggcaagaagtatggatgaaacatatctgaccttgaatggacagattgaagctgggaaactattatgtcaattcttccaattttgtttatgtttgaaaattttcataataaaaatttttattgtatagtaatttatttagtaagcaggtaaaaatgttaaaaaatttgtaagtagctgtatccgtttggggcttgggatatcagtacttctctgctaaaagtatcatcatagaggtgagcaaatctacacaaaggaaatataacaggtgtagtttttaaaaggaagaaagaaaaacacttcacaaataatgtgattagtaaaacccaaggtaatcaaagaattgcaataataaaatttcatcaaaacggcacaatggagaatgatctatgcataataacgtgagatctattagttttgtgtgtattgaactaagaaatccatttaaagtattcaaattaaaaaaaattaaataaatacaatttttagcttacaagtttactgaacatgatattattctatgttgctgcttttcttttagacagtttcggtcaaattattccactatttactgaaaatattaaaaataataacgcgtgttgccattcttgcacaacactgtagttaaaggtgtgactctgtaaaagtccctgccagtgaggcaactcaagggagacagatgtgaaaataggtattagaatacagcaggaaaaatgtaacagtgacacaaggaagcacagagcatactgagaaataatccatcaacattcttttttccatttgggggatcaggtaaagagaagaccgagcaaatttggtgaaaatcctaccacgatgttaacttttgagcctgaactagaaggatgcgaaagacttagacattataaatggatgaaaggcttcatacaggcatttcagtgacacagaatgtacaaagacaaaaagtacagccatgatcaatgaaggagagcaattgtatggtggacaaagaagggaaaagcagaagttagaaagacagtcagggccatggtcccgtagagtgctgtgggtcatactaatgaatttgggctaaattctatagtagagggaaattatagaaatatcttatatacaagattggtgtaaacagatgcatttcaagagctccctcaaacaagatagttgcttaacatgatggaataacatgtagtgaatttgaaggaggctcatatgtacaaagattggtagaaacagtgtgaaattcaaaatgagtgaaaaaagattacatattgtaggtggtatgtatgctccttaaaaaatgagagaatttagaaaaaacttttataatttactagtccctgggttatgttggtaatgtgatatggaattcatagttagaatgagattcttgattagggggagaaaaataattgctttagctgagatatacaaaacaatttaataatatatatattattaaatgtacctatgttactgggaaatagggacttttgagacctgcagtttggataaagcagctgtttggaaattggcatcactatcagtgggaaatttgttgataactgggcttcagggtatggctcccccttctgcctcccctcacccccgacctggttataacaaccacatggcacatgctgggaggatgcccgggttgccaactcaacccaggggcctcagctggggaaggacagaagatttatgtatgcacagactctgttttaacttctgagaagactaaggggctaggagggaccaactgagtgcacagctgtttgaaagaaacaggcctgcaggagagaagggtggggtggatgggcagagtcctaaagtcatcttctagttctacaggaatctaagaacaacagattctgtttttggagaagcacacattaaagaagaaaatccagagaaacctcatgaacctgtacagcatcatgtagcatctatccatgggagcagctgggtgtgggctgagtgcagcttcaggtggcgaatttgggttttagtaggatagaagacttgtcgggctttctctgtccattacaaaagatgggttcagtaaatatgagttacctgagagaaataagagatagagaaaaaatgatggcagggttatgggacctccatatactgtgactgtggacactgatgtctcccaggaagcaggcactctcatgggggcatgaggctggtgcatgaggcaaacaggcattaagcagtgttatgtctgagtattattcattttactattgttatttaagattgtcttaatagtaatattaaatcacgtacggtctggggccggcccactggtgcagtggttaagttcgtacattccacttcttggtggcccggggttccccggttcagatcctgggtgtggacatggcaccacttggcacgccatgctgtggtaggaccagaatccaacattggtctccaactgaccaggccagtgccttccacaccacacactctgtttcaggccctccataaggatacacaaggagggtcattgagggcccagcacaggcagcaagtctgaggtctgaggtctaacatcagggcctccagttctgccactctccaggtggctgggatgggcagaagggaggtaggccctgcccatctgaaggataggacaacctgcagagcgggacagatttatcccaagaccagtgacttaactttccaaatactgaccatgtgggatctgttctgagacatttgcctaaaagcacatgcagaggggcatccagtgtgcagattcataaactggcaaagatctgctttatgtgaaaagccagtattttccagtactgacagctaactctgtgcagaatctgtgtccacccactgcactgagagaccactccaagaccctggaagtgcaggttcctgagcccacccagacccactagtccaatcccaggaaaggactccaggaacctgctcccccaggggcaccagaagcagggcctgggctgagagtttcagggcagagacacctgtccaagggagggagggaagaatgagagagctcagattctgataagccagcctccacaggctctgggcgcaccaaagtgcctctggtgccaaagaacagaaggagggactgcaggaggtcacatctgggtccagattccctctgcacaagcctgggtaagttacatcaactcttggagcctcagtttcccaatctgtaaaatgaggaatcaacaccatgccactgtaagtgcagaacctgaccctgctgggtgcttgacaccttcattccaaggcagaagggataatcaggggaatacagtcaatgatgatggagagggtgactctgagggtaggggtggtggaggggttgccgtgggtggggaagacaggtgttccagagttgagggtggggaagggggtactaggggtgggaatgtgagggagataagggctctggggagatggggatggggtggggggttcacagggagtgtggatgaggaagggacactaggattggggacataggagatgggggctctgggggtgaggatggcgggagaaaggctttatgttggtggggatatgcagggagaggccaggctgaaacctcccccagcacacccctgcccatggtgctgtaagggaggaagagaattcctctaccctctttaggtccttctggctggcctaagaattaaattgacatgagacagaacaacagaagaaaatcaaacaaaacattataatgtgtatacatgggacaaacccagaaaactgggtaactcagtcagaatggctggagctgtcatcttaaatatcagcttcagctaaagacaaaggaggatgttgggggtagtggtttgaggcttgaaaagcaagacgaagaaggcaattcatacggatggagaagcaaatgtttgctagacaagatgagcttagcaaggaccctcactgtctatggatactctgagttatctatggtgatgtgctgtcatggggacaggccttttatcttacattcttttaggcagttgggggaaggtcagtttttttcagagcctttgtctttgaaaccaagccaaagagacacattttgaggtgaccaattttgatgccccacagagcagagaagagattttcacatattgaggtatattgggtaactatttgggttcgaaactgatttggcttgaactaacaaagcctgccttatggtctatcaaatatacatcatatatgtgctttaagcattaaagtaaagaatgcactctcttaggaatgcatacttcccctcctcagccctaatggtaacaccctattggtaatgcccatattagtccctttcttgacatcagggtcatgttgacctgctaatttgcaatggaatgtctctatgaaattttgatgactatgtatcctgggtgtgtttaatgtatgttctttgttctaaaaagatatatcactgtactgaaaacgatgcttctccagaaagctttcttcctttctgaaaaagtttttcgcaggttataatcttcattctggatcaagtaaaactcatgttctctctcttatctatagaacagttattgattattttgcattgacccttcttggtgtagtgggaagattacagagaaacccactggagaccacctttgaactggtgcttggtaccatataggcccattgagctcctctgacttcaaggcactcttcaaatgcactcagtgagtttctcctaaaggctgcacctccttaagtcgcagatcctgactttagtcttaagactagatttctcaagggggtactggtacatttcccaggtaatgatgaggattattttaggctggctacttttaaaaactgcagaagagaaggaggctctgaggagtggagtttgcttgccctttgatgagagacatttgcatttgtgaaggaagtctccacctgtgggcgtgtctccctctcttcaccaggaggaagagggggtgaccctatctctggaaactcttaatggggaaggcaaggacttaagttgtttactgtttggtaacctcatgtaactgacgaccccaccaacatcctcctttgtctttagctgaagataatttttaatatggtggcttctgccatttacttaatctgggttgattgttatctaaaggttataggaccactcaataaccagaccccacctgccctgataccattttaacaacaattttacatattattttctttgtcttgtaaagagataactcacatacctatgcctaaaacttagccctactctcaagccatgtttgcagcagcagcagcagctcctcctgcccatgggtcccatccccacacagcatctcctcctgcccgtgggtcctgtccccacacaacagctctgactgtccataggtcctgtccccatgctattccatacaattctctaaataaaagagcactactgccaggcctggagagtccaagaagtctttctttcgactcttcatctcgctgaccacgcaacagtaagagaaaactggcaggaacgtccttggccagggtaacctagagggacctttggaatgaatgggacaggctgaccttttaaatttgcctttaagttggaaagaactgtgtccatagtgtctaaacgaattacttaatagcaaaatgagagactgaaaggtcagtcagctcagaaaagaagggataccatctccacccagtctaatgaattctcaggtgactgagaacctagtggcagtgtctgagcttgagcctcatgatgcacagcagtcccatggggaattccattgtgatcatgcactttaattgacacctcatccagggatgtgcacatgagggttggatagacacacactccaaacctccatggtagttttagtctgctggcaggagaaactgagacagataagagaatgttcatgatatttttagggagggaactcacaggcaacacacttctgaccaagtactctgtccttagaaattgttcagactttatagtaaaatgaaactaaacaaagaatgggaaatcaggctcccgaataggcagcctccccttggagctctggctggcttcacacatgatacgtgcagaaaatatacttgcaaacacctaacaaagcagggataaatgtaaatggttggatctttagagaagataagctgggataatttaaaatttcagtggccactttgtggttcctttgatcatccaaagcttgtatattggccattagaaggaaagttcaaattagacaagatcatttaagaagtgcacttgttaagtcatgagtttacaagcaatcatgtaatctaccttcataggtggacacaatatgagcctctcccaaggttaatgagattctgaaagatttcttgggatgtgctacccttaaacagttaatgggaaactaaaatgaaaaaagtaatgtagctgtttaatgctgcgaggaacagttgcagtttgtcccctctgaaagtggacaagatatttgagaggatttaataacttgtgatgagaaatttggccaaattggaagctgacattcaaagacagataggaatttttaaagattttcttccttaaatttagataaaatgaagtatacagggcctggtcctgtggccaagtgcttaatccctgactgtggataccgtgcccctgcagtggatgcagtgtccatgaaggtggatagagtgtccttgaggtggatgcagtgtcccagaaggtggatgcagtacgttctaatggtcagggcagtgtacatgaaggtagatgcagtgcccctgcagtggatgcagtgtccctgcggtggacctggaggtggatgtagcatcactgatatggattaagtgtccttgaaggtggatgcagtgtcactgaggtggatgcagtgtcccagaaggtggatgcagtatgttgtgaccgaggatgcagtatccatcaaggtggatgcagtgatgctccagtgattgcagtgcccatgcagtgccaattaagctggatgcagtgaccctgcagtggttgaagtgcccctgcagtgtccctgagtgtggaggcagcgcccatgcagtggaggcagtgtcccagaagttggatctagtgcccccaaagatgaatgcaatatctgctgaaggaggatgcagtgcctgtgaatgtggatgcaacgtccctgaggtcaatgccgtgaacatgcagttggatgcattgggcaccaatatgaatgcagtgccttctgagggtggaggcagtgcctgcgctttgtattcagtgttcctgaaggtggatgcagtgcacgcgaaaatgaaaccagtaccttctgaaggtggatgcactgaccttgaagtggatgcagtgtctctgaaagtggatgtagtgttcgtgaagttttatgcggtgccctgcagtggaggcagtgtccatgaaggtgggagcagtgcctccaggtggtgcagtgtcaaagcaggtggatgcattgccttcggatggtggttgcagtatatcagaagcgggatgcagagcccactgaagatggttgcagtgacccagtggtggatggattgtgccctgcatgtggatgcagtgtcccacaaggtggatgcactgtcccagaaggtgcatgcagctcttcctgaagatagaagcagagggcaaagatgaatgcagtgccttctgaaggtggaggcagtgcccatgcagtggatgcagtgtccctgcactggttgcattgccgcctgcattgtccgagaatttggatgcagtgcccaggcaatggatgcagagccccacaaggtggatgcaatatgttgtgacagaggatgcagtgcccatgaaggtggatgcagtgatcacgcagtggttgcagtgtcccctgcagtttacctgaatgtggatgcagtgctcatgcagtgtccctcaggtggatgccttatgctgtgatggaggattcagtgatcatgaaggaggatgcagtgatcctgcagtcattgcagtgttcctgaagtgccacttcagctgggtgcagtgtccctgcagtggctgcagtgccccgttctgtgtccctgaatgtggatgcagtgcccatgcattggatgcagactaccaaaagttgggtgccgtatgttttgacagaggatgcagtgcccacgaggtggatgcagtgagacggcagtgattgcagtatgccttcagtgccacttcagctggatgcagttgtgctgcagtggttgcagtgtcccctgcattgtccggaaatgtggattcagtcccccggcagtggatgcagtttcccacaaggtggatgcagtatgttatgacagatgatgcagttctcatgaaggtggatgcagtgtcccagcagtgcttgcagtgcccccccacattctccgggaatgtggatgcagtagtcatgcagtggatgcagtgtctgacaaggtggatgcagtatgttgtgatggagaaagcagagcccatgaaggtgtatgcagtgatgctgcactggttgctgtgttctctgcagttcactgaatgtggatgcagggcccaagaagtgtttgcagtgccccctgaattgtccgggaatgtggatgcagtgcccaggcagtgaatgcagtttcccacaaggtggatgcagtatgttatgacggatgatgcagttctcatgaaggtggatgcagtgtccctgcagtgcttgctttccccccggcattgtctgggaatgtggatgcactagtcatgcagtggatccagtgtcccacaagctgtatgcagtatgttgtgatgtaggatgcaatgcccatgtacgtggatgcagtgatgctgcagtggttgcagtgctccctacaattccctgaatttggatgcagtgcccatgcagtagttgcagtgtcccaaaaggtggatgtcgtatgttgtgatggaagatgcagtgcccatgaaggtggatgcaatgagcctgtgcagaatgcagtgcacctgcagtgcgacttcagctgtattcagtgtccctgcagtggttgcagtatggactgcattgtccgagaacatggatgcagtgcacaggcattggatgcagtgtcccacaaggtgcatgcagtatgttgtgatggaggatgcagtgaccatgaaggtggatgcagtgatctggcagtggttgcagtgcacgattctgtgtccctgaatatggatgttgtgaacattcagtggatgcagtgatcctacagtcattgccgttgacctgcatttccacagtagctggaagcagtgcccctgctggggttgcagtgctgccttctgtgtccctgaaggtgaatgcagtgtccatgcagtggaggcagtgtccctaaaggtttatgcattatgttgtgaaggaggatgcagtgcccatgaaggcggatgcagtgtccctgcactgcttgcagtgcccacgcattgtctgggaatgtggaggtagtagtcatgcagtggatgtagtgtccctcaaggtggattccttatgttatgatggaggattcagtgatcatcaaggaggatgcagtgatcctgcagtcattgcagtgctcctgaagtgccacttcagctggcttcagtgtccctgccgtggttgcagtgccccgttctgtgtccctgaatgtggatgcagtgcccatgcagtggacgcagagtaccaatagttggttgccctatgttgttacagaggatgcagtgcccaggcgttggatgcagtgagctggcagtgattgcagtaggccttcagtgccaattcagctggatgcggtgtccctgcagttgtttcagtatgaactacattgtccgagaacgtggctgcagtgtctgggcattggatgcagtgtcccacaaggtgcatgcagtatgttgtgatggagaatgcagggcaaatgatggtggattcagtgatctggcagtggttgatgtgcagggtgctatgtccctgaatgtggatgctgtgaacatgcagtggatgtagtgtcctacaatgtggaggcattgtggtgtgttgtagtatgcagtgcccatgaaggtgaatgcagtgatcttgtagtgatggcagtgcaagtgcagtgaagcttcagctggatgcagtgttgctgcagtggttgcagtgccccctgcaatgtccgggaatgtggatgcagtgcccaggcagtggatgcagtttccaacaaggtggatgcagtttgttaggacggatgatgcagttctcatgaaagtggatgcagtgtccctgcattgcttcagtgcccctggaattgtcaaataatgtggatgcagaggtcatgcagtggatgcagtgtctcacaatgcacatgcagtatgttttgtcggaggatgcatttccaattcagctggatgaagtattgctgcagtggttgcagagccaactgcagtgtccctgaacgtggatgcagtgcccatgcagtgtatgtagtgtcccacaaggtggatgcagtacgttgtgatggaggatggagagccctcgaatttggatgcagtgagccagcagtggttgcagtgtcccctgcagtttacctgaatgtggatgcagtgcccaggcattagatacagtgtcccatatgttgcatgcagtatgttgtgatggaggatgtggtgcccatgaagggggatgcagtgtccctgtagtggttgcagtgccccctgcattatcctggaatgtggatgcagtgctcatgcagtggatacagtgtcccacaaggtgagtgtagtatgctgtgacggagcatgcagtgcccacgaatgtcgatgcagtgatcctgcagtgatggctgtgcaccttcagtggcagttcacctggatgctgtgttcctgcagtggttgcagtggcccctgcatgtccgggaatgtggatgtagtgcccaagcagtggatgcagtatcccacaaggtggatgcagtatgttatcacggatgatgcagttctcatgaaggtgaaagcagcgtccgtgcagtgcttgcagtgccccccgcattgtccaggaatgtggatgcagtagtcatgctgtggatgcagtgtcccagcagtggttgccgtacagccttctgtgtgcctgaacgtggatgtagtgcctatgcagtggatgcagtgtcccacaatgtgcatgcagtatgttgtgatggaggatgcagtgcccatgaaggtggatgcagtgatcctgcagtggttgcagtgcccccttcagtttacctgaatgtggaagcagtgctcccgcagtggatgcagtgtccctcaagttggatgccttatgttgtgatggaggaatcagtgataatgaaggtggatgcagtgagcatgtagtgaaggcagtgtccctaaagccttatgcagtatgttgtgacggaggatgcagtgtgcatgaaggcagaggcagtgtccctgcagtggttgcaatgcccactgcattgtccaagatcgtggatgcagtgcccaggcattggatgcagtgtcccacaaggtgcatgcagaatgtgacggaggttgcagtgtccatgaggcaggatgcagtgatccggaagtggttgcagtgcaccatgctgtgtccctgaatggtcatgatctgaacatgcagtggatgcagtgatcctgcagtgatggcagtgtgcctgcagtgccacttcattggatgcagtgttctggcagtggttgcagtgccccctgaattgtctgggaatgtgaatgcagtgcccatgcagtggatgcagtgtacctaaaggtttgcgcagcatgttgtgatggaggatgcagtgcccatgaaggaggatgcagtgtccctccagtggttgcagtgcccctggcattgtcctgaaatgttggtgcagtgcctatgcagtggttgcagtgaatcttcagtgattgaagtacgcctgcagtgccacttcagctggatgaagggtagctgaggtcgttgcagagctactgacatgtccctgaatgtggatgctgtgtccatgtagtatctgcagtgtgattcaagttggatgcagtatgttgtgaagcaggattcagtgcacatgaaggatgattcagtgatcctgcagtcattgcagtacacctgcagtgccacatcctctggatgtagtgtccctgcagtggctgcagtgcaccctgctgtgtccctcaatgtggatgctgtcgacatgcagtcaattgagtgatcctgcagtgattgcagtgtgcctgcatttcctcatcagcaggaagcagtattgctgcagtggttgcagtgctgcgttctgtgtccctgaaggtgaattcagtgcgcatgcagtgaaggcagtgtccctaaaggcttatgcagtatgttgtgacggaggatgcagtgtgcatgaaggcagaggcagtgtccctgcagtggttgcaatgccccctgcattgtcctggaatgtggatgcagtgctcatgcagtggatgcagtgtcccataatgtggaggcattgtactgtgttatagcatgcagtgccgatgaaggtgaatgcagtgatcctgcagtgatggcagtgtgcctgcagtgccacgtcagctggatgcagtgttgctgcagtggttgcagtgtcccctgcattgtccaggaatgtggatgcagtgcccaggaaggggatgtagtgtcccacaaggtggttgcagtatgttatgacagatgatgcaattctcatgaaggtgtatgcagtgtgcttgcagtgcttgcagtgccccccacattgtccggtaatgtggatgttatagtcatgcagtggatgcagtgtcccacaagatggatgcagtatgttatgacggatgatgcagttttcatgtaggtggatgcaatgccccctgcattgtcctggaatgtggatgcagtagtgatgaagtggttgcagtgtcccacaaggtgaatgcagtatgttgtgatggaggatgcagggcccatgaaggtggatgcagtgatgctgcagtggttgcagtgcccactacagttccctgaatgtgtatgcagtgcccatgcatagttgcagtgtcccataaggtggatgttgtatgttgtaatggaagatgcagtccccacgtaggtggatgcagtgagcctgtggtgaacgcaatgcacctgcagtgcgacttcatctggatgcagtgtccatgcagtggttgcattgccgactgcattgtccgagaatgtggatgcactgccccggcattggatgcagtgtccctcaaggtgcatgcagtatgttgtgacttatgatgcagtgcccatgaaggtggattcagtgatctggcagtggtttcagtgcaccctgctgtgtccctgaatatggatggtgtgaacatgcagtgtatggagtgatcctgcagtgattgcagggcgcctgcatttccaaatctgctggaagcagtgtcccagcaggggttgcagtgctgccttctgtgtcactgaacctgaatgcagtgcccatgaattggatgcagtgtagctaaaggttgatgcattatgttttgagtgaggatggagtgcccatgaaggtggaggcagtgtccctgctgtggttacagtgcctcaggcattgtactgcaatgtggatgcaggggtcatgcagtggatgcagtgtctcacaaggcagatgcagtatgttttgtcggagcatgcagtgccacttcagctggatgcagtgctgctgcagtggttgcagagccaactgcagtgtccctgaacgtggatgcagtggccatgcagtgcatgcagtgtcccacaaggtggatgcagtatgttgtgacagaggatgcagtgcacatgacggcagatgcagtgtccagacagtggtatcagggaccccagcattgtgccggaatgtggatgcagggggcatgtagtggatgcaatgtctcacaaggcggatgcactattattttttggaagatgaagtgcccatgcagtggatgcagagtaccaaagttggttgcagtatgtcgtcacagaggatgcagtgcccacgagttgtatgcattgagctgacagtgattgcagtacgccttcagtgccacttctgctggatgcagtgtccctgcagtggttgcaatgcccgtggccttgtcctggaatgtggaggcactgctcatgctttggatgcagtgtcccacaatgtggatgcagtatgttgtgacacatgatgcagtgccaacgaatgtggaagcagtgatcatgatgtgattacagtgcgcctgcagtgccacttcagctggatgcagtgttgctgcagtggatgcagagccaacagcagtgtccctgaacgtggattcagtgaccattcagtggatgaagtgtcccataatgtgcatgcagcatgctgtgacagaggatgcagggcccatgaatgtggatgcagtgatcctgcactggttgcagtgccccatgcagtttagctgaatgttgttgcagtgctcatgcagtggatgcagtgtccctcaaagtgaatgacttttgttgtgatgcaggattcagtgatcatgaaggaggatgcagtgattctgcagtcatggcagtgcacctgcagtgccatttcagctggctgcagtgtccctgcagttgttgcagtgccccgttctgtgtccctgaatgtggaggcagtgcccaggcagtggatgcagagtaccaaaatttggttgccgtatgttgtgacagaggacccagtggccacgagttggatagagtgagccggcagtgattgcatacgcctacagtgccacttcagctggatgtagtgtccctgcagtggtttcaatgccccctgcattgtcctggaatgtggatgcagtgcccatgcagtggatgcagtgtacctaaaggtttatccactatgttgtaacggaggatgcagtgcccatgaaggtggatgcagtgtccctgctgtggttgcagtgccaccggcattgtcctgtattatggatacaggggtcatgcattggaggcagtgtctcacaaggaggacgcagtatgttctgtcagagcatgcagtgcccatgaagatggatgcggtgaacctgcagtggtgacagtgtcccctgcagtttaactgaatgtggatgcagtgcccatgcagtgcatgcattgtcccacatggtggatgcagtatgctgtgatggaggatgcagttcccacgaaggaggatgcagtgagcctgcagtcattgcagtgcgcttgcagtgccacttcagctggatgcagtgttgctgcaggggttgaagagccaactgcagtgtccctacacggggatgcagtgcccatgaagtggatgcagtgtcccacaatgtgcatgcagtatgttgtgtcggaggatgcagtgcccatgaagttggatgcagtgatactgcagtggtttcagtgcccctgcagtgtacatgaatgtagatgcagtgctcatgcagtggatgcagtgtccctcaatgtggatgtcttatgttgtgttggaggattcagttatcatgaagcaggatgcagtgatcctgcagtcattgcagtgcaccagcagtgccacttaagctggctgcattgtcccagcagtggttgcagtgccaccttctgttttcctgaatgtgaatgcagtgcccatgcagtagttgcagtgtcccacagggtggatgtcgtatattgtgatggaagatgcagtgcccacggaggtggatgcagtgagcctgttctcaatgcagtatacctgcagtgcaacttcagatggatgcagtgtccctgcagtggtttcagtgaacactacattgttcgagaacgtggatgcagtgcccgggcattggatgcagtgtcccacaaggtgcatgcattatgttgtgaccgagaatgcagggcacatgaaggtggatgcagtggtcaggcagtgcttgctgtgcaggctgctgtgtccatgaatgtggatgctgtgaacatgcagtggatgcagtgtcccaaaatgtggaggcattgtggtgtgttgtagtatgcactgccaatgaaggtgaatgcagtgatcctgtagtgatggcagtgcacgtgcagagcgacttcagctggatgcagtgttgctgcagtggttggagtgccccttgcattgtctgggaatgtggatgcagtgcccaggcagtggatgcagtttcccacaaggtggatgcagtatgttatgacggatgatgcagttctcatgaaagtggatgcagtgtccctgcagtgcttgcagtgccccccgcattgtccgggaatgtggatgcagtagtcatgtagtggatgcagtgtcccacaaggtggctgcagtatgttgtgatggaggattcctggcccatgaagttggatacaatgttcctgcattggttgcagtgccacgttctgtgtccctgagtgtggatgcagtgcccatgcagtggatgcagagtaccaaaagttggttggcgtatattgtgacaggggatgcagtgcccacgagttggatgcagggatgcagtgagccggtattaattgcagtacgccttcagtgccacttcatctggatgcagtgtcccagcagtggttgcagtgcccactgcattgtccgagaaggtggatgccgtacccaggcattggatgcagtgtaccacaaggtgcattcagtatgttgtgatggaggatgcagtacccatgaaggtggatgctgtgatctggcagtggttgcagtgcacgctgctgtttccctgaatgtggatgctgtgaacatgcagtgtatgaagtgatcccgcagtgagggcagtgtgcctatatttccacatcagctggaagcagtgtccctggaggggttgcagtgccacttctgtgtcccgtaggtgaatgcagtgcccatgcagtggatgcagtgtacgtaaaggtttatgcagcatgttgtgacggaggatgcacttcccatgaaagtgtccctgcactgtccctgcagttgctgcagtgcccctggcattgtcccataatgtggatgaaggggtcatgcagtggatgcagtgtctcacaaggcagatgcagtatgttttgtcggaggatgcagtgccacttcagctggatgcactgttgctgcagtgcttgaagagccaactgcagtgtccctgaacttggatgcagtgccgatgcagtgcatgcagtgtcccacaatgtggatgcagcatgttgtgacggaggatgctttgccacttcagctggatgcatgttactgcagtggttgcagtgccctgttctgtgtccctgaatgtgaatgcggttcccatgcagaggatgcggagtaccaaaagttggttgccgtatgttgtgacagaggatgcagtgcccacgagttggatgcagtgatcctgcagtgattgcagtgctcctgcatttccacatgagctggaagcagtgtccctgcaggggttatagtgctgccttccgtgcccctgaaggtgaatggagtgcctattcagtgggtgaagtgtacctaaaggtttatgcagaatgatgtgagggaagatgcagtgcccatgaaggtgcatgcagtgtccctgcagtggttgcagtgcccacggcattgtcctggaaagtggatgcagcggtcgtgcagtggatgcagtgtgtcacaaggcagatgcagtatgctttgtcggaggatgcagtgccatgaaggtggttcgatgaaactgcagtggctgtagtgccacctagagtttccctgaatgtggatgcagtgcccatgcagtgcatgcagtgtcccacaaggtggatgcagtatgttgtgacggaggatgcagtgcccacgaaggtggatgcaatgagactgcagtgcacctgcagtgccacttcagctggatgtagtgttgctgcagtggttgcagagccaactgcagtgtcgctgaacgtggatgcagtgcccatgcagtggatgcagtgtcccacaatgtgcatgctgtatgttgtgacgaaggatacagtacccatgaaggtgtatgtggtgatcctgcagtggttgcactgccccctgcagtttacctgaatgtggatgcagtgctcatgcagtggatcctgcagtcattgcagtgttcctgcagtgcctattcagctggcttcagtgttcctgaagtggttgccatgccccgttctgtgtccctgagtgtggatgcagtgctcacacagtagttgcagtgtcccagaaggtggatgtcatacgttgtgatggaagatgcagtacccatgaaggtggatgcagtgagtctgcagtgattgcagtacgccttcattgccacttcagctgaagtcagtgtccctgcagtggttgcaatgcctcctgcattgtccgggattttggatgaagtgcccaggcagtggatgcagtgtcccacaaggtggacgaagtatgctatgatggatgatgcagttctcatgaaggtggatgcagtgtccttgcagtgcttgcagtgcccccacactgtccgggaatgtggatgcagtattcatgcagtggatgcagtgtcacacaatgtggatgcagtatgttctgatggaggatgcagggcccaggaaggtggatgcagtgatgctgcagtggttgcagtgccccctacagttccctgaatgtggatgcagtgcccatgccatagttgcagtatcccacgagatggatgtcatatgttgtgatggaagatacagtgcccaagaagctggattcaatgagcctgtgctgaatgcagtgcacctgcagtgcgacttcagctgtatgcagtgtccctgcagtggttgcaatgccgactgcattgtccaagaacgtggatgtagtgcccagccattggatgcagtgtagcacaaggtgcatgcagtatgttgtgtcagaggatgcagtgccaatgaaggtggatacagtgatccagaagtggttgcagtgcaccctgctgtgtccctgaatgtggatgctgtgaacatgcagtggatgcagtgatcctgcagggatttcaattcgccagcatttccacatcagctggaagcagtgtccctgcagtggttttagtgcagccttctgtgtccctgaaggtgaatggagtgcccatgcagtggatgcagtgtagctaaaggttgatgcactatgttttgagtgaggatgcaatgcccatgtaggtctatgctgtgtccctgctgtggttgcagtgcctccggcattgtcctggaacgcggatgcaggaggcatgcagtggatgtagtgtttcaataggcggatgcagtatgttttgttggaggatgcattgcccatgcagtgcatgcagtgtcccacaaggtggatgcggtatgatgtgacggaggatgcagtgcccacgaaagtggatgcagtgagccttaagtgattgcagtgcgcttgcagtaccacttcagctggatgcagtgttgctgcagtggttgtggagaaaactgcagtatccctgaacgtggatgcagtgcccatgcagtggagggagtgtcccacaatgtgcatgcagtatgttgagacagaagatgcagtacccacgaaggtggatgcagtgatcgtgcagtggttgcagtgccccctgcagtttacctgaatgaggaagcagtgctcatgcagtggatgcagtgtccctcaaggtggatgccttatgttatgaaggaggatgcagtgatcaagaaggaggatgcagtgattctgcagtcattgcagtgcacctgcagtgcctcttcatctggctgcggtgtccctgcagtggtttctgtacagccttctgtgtccctgaatgtggatgcaatgcccatgcagtggatgcagagtgccaaaagttggctgccatatgttgtgacagaggatgcagagcactggaggtggatgcggtgagccggcagtcattgcagtatgccttcagtgccacttcagctggatgcagtgtccctgcagtggtttcaatgccccctgcattgtcctggaatgtggattcagtgctcatccagtggatgcagtgtcccacaatgtggaggcattgtggtgtgttgtagtatgcagtgccgatgaaggtgaatgcagtgatctggcactgatttcactgcgcctgcagtgccacttcagctggatgcagtctttctccagttgttgcagtgccccatgcattgtccgggaatgtgggtgcagtgcccaggcattggatgcagtgccccataaggtggatacagtatgttgtggtggaggatgcaggacccatgaaggtggatgcagtgatgctgcagtggttgcagtgccccctacagttctctgaatgtggatgcagtgcccatgcagtagtttctgtgtccaacaaggtggatgtcgtatgttgtgatggaagatgccatgcccacggaggtggatgctgtgagcctgtgctgaatgcagtgtacctgcagtgcaacttcagctgtatgcagtgtccctgagtggttgcagtgccgaatgcattgtccgagaagatggatgcagtgcccaggcattggatgcagtgtcccacaaggatgcagtatgttatgatggatgatgcagttctcatgacggtggatgcagtgtccctgcagtcgttgctgtgcccctggcattgtcctgatatgttgacgcagtacctatgcagtggattcagtgaatcttcagtgattgcagtgcacctgcagtgtcacttcagctggatgcagtgtagctgcagtggttgcagagccccctgccatgtctctgaatgtggatgatgtgcccatgcagtgcctgcagtgtgactcaaggtggatgcagtatgttgtgaagcaggattcagtgcccatgaaggatgatgcagtgatcctgcagtcattgcagtgcacctgcagtgccacttcatctggatgcagtgtccctgcagaggttggtgtgcaccctgctgtgtcccagaatgtggatgctgtgaacatgcagtggatgcagtgatcctgcagtgattgcagtgcacctgcatttcctcatcagctggaagcagtgttgctgcagtggttgtaaggccgccttctgtgtccctgaatgtgaatgcagtgcccatgcattggaggctgtgtccctaaaggtttatgcagtatgttgtgacggaggatgccgtgcacatgaaggcggatgcagtgtcccttcagtggttgcaggacccccggcattgtgctggaatgtggatgtaggggtcatgcagtggctgcagtgtctcacaaggcggatgcagtatgttttgtaggaggatgcagtgcccatgaaggtggatgcggtgaacctgcagtggttgcagtgcccactacagtttccctgaatgtggatgcagtgcccatgcagtgcattcagtgtcccaaaatatggatgtgatatgctgtgatggaggatgcagtgcccaaaaatgtgggtgcagtgtccctgcagtgctttcactgccccctgcattgtccgggaatgtggatgcagtagtcatgcagtggatgcagtgtcccataagttggatgtcatatgatgagatggaagatgctgtgcccatgaaggaggatgcagtgagcctgctgtgatggcagtacgcctccattgcctcttcacctgaagtcagtgtcccttcagtggttgcaatgccccctgcgttgacccggattgtggatgcagtgcccaggcattggatgcagtgtcccacaaggtggatgcagtatgttatgaaggttgatgcagttctcatgaatgtggatgcagtgtccctgtcatgcttgcagtgccccccatattgtcggggaatgtggatgcagtagtcatgcagtggatgcagtgtcccacaaggtggatgcagtatgttgtgatggaggatgcagagaccctgaaggtggatgcagtgatgctgcagtggttgcagtgccgcctacagttctctgaatgtggaagcagtgcccatgcagtagttgcagtgtcccataaggtggatgccgtatgttctgatggaagatgcagtgcccacgaaggtggatgcaatgagcctgtgctgaatgcagtgccagtgcagtgcagattcagctgtatgcattgtccctgcagttgctgcagtgcccactgcacagttcgagaacatggatgcagtgcccagggattgtatgcagtgtcccacaacgtgcatgcagtatgttgtgacggaagatgcagtgcccatgaaggtggacgctgtgttccggcagtggttgcagtgcacctgcaattccacatcagctggaagcagtgtccctgcaggcttgaagtgcagccttctgtgtccctgagggtgaatttagtgcccatgcagtggctgcagtgtacctaaggtttacacagtacgttgtgatggaggatacagtgcccatgaaggtggattcagtgtccctgcagtggttgcagtgcacccagcattgtcctggaatgtggatgcaggagtcatgcagtggatgcagtatctcaaaaggcagattcagtatgttttgttggaggatgcagtgcccatgaatgtggattcagggtccctgcagtggttgcagtgcccactgcattgtctgagaacgtggaagcattgcccaggcattggatgcagtgtctcacaaggtgcattcagtatgttgtgacggaggatgcagtgtccatgagggtggatgcagtgatccggcagtggttgcagtgcaccctgctgtgtccctgaatgtgcatgctctgaacatgcagtggatgcagtgatcctgcagtgatgccagtgcacctgcagtgccactgcagttggatgaagtgtgactgcagtggttgcagtgcccctgcattgtccggactgtgaatgcaatgcccatgcagtggatgtagtgtacttaaaggtttatgcaatatgttgtgatggaggatgaagtccccatgcagggggatgcagtgtccctgcagtggttgcagtgcccccggcattgtcctgaaatgttgatgcagtgtctatgcagtggttgcagtgaatcttcagtgattgcagtgcgcctgcattgccacttcagctggatgctgtgtagctgcagtggttgcagagccccctgccatgtccctgaatgtggatgctttgtccatgcagtgtctgcagtgtgactcaaggtggatgcagtatgttgtgaagcaggattcagtgcccatgaaggatgatgcagtgatcctgcagtcattgcagtgcaccttcagtgccacttgatctgtatgcagtgtcccaggagtgattgcagtgcactcggctgtgttcctgaatgtggatactgtgaacatgcagtggatgcagtgatcctgcagtgattgcagtgcgcctgcatttcctcatcatctggaagcagttttgctgcagtggttgcagggcccccagcattgtgctggaatgtggatgcaggggtcatgcagtggatgcagtgtctcacaaggtggatgcagtatgtttatcggaggatacagtgcccatgatggtggatgcaatgagcctgcggtgattgcagatcacatgcagtgcctcttcagctggatgcagtgttgctgcagtggttgcagtgccgcctgcattgtccgggaatgtggatgcagtgtccagtcagtggacacagtatgttatgatggttaatgcagttctcatgaaggtggatgcactgtccctgcagtggttgcagagccccgggcattgtccgggaatgtggatggagtgcccaggcagtggatgcagtgtcccacaaggtgaatgcagtatgttatgacggatgatgtaattctcatgaaggtggatgcagtgagcctgaagagattgcagtgcgcttgctgtgccacttcagctggatgcactgttgctgcagtggttgcagagacaactgcagtgtgcatgaacgtggatggagtgcctatgcagtggatgcagtgtcccagaatgtccatgcagtatgatgtgatggaggatgcagtgcccatgaaggtggatgcagtgatcctgcagtggctgcagtgtcccctgcagtttacctgaatgtggatgcagtgctcatgcagtggatgcagtgcccctcaatttggatgccttatgatgtgttggaggagtcagtgatcatgaaggaggatgcagtgatcctgcagtcattgcattgaacttgcagtgccacttcagctggctgcagtgtccctgcaggggttgcagtgccccgttctgtgtccctgagtgttaatgcagagcccatgcagtggatgcagagtaccaaaagttggttgctgtatgttgtgacagaggatgcagagccctggagttggatgcagtgaactggtggagaaagcagtaagccttcagtgccacttcagttggatgcagtgtcgcagcagtggttggaatgccccatgccttgtcctggaatgtggaggaagtgctcatgcagtcaatgcaatgtctcacaatgtggaggcattgtggtgtgttgtagtatgcagtgctgatgaaggtgaatgcagtgatcctgcagtgatggcagtgcatgtgcagtgccacttcagttggatggagtgttgctgcagtcgttgcagtgccccctgcattatctgggaatgtgtatgcagtgcccaggcagtggatgcagtgtctcacaaggtggatgcagtatgttatgacggatgatgcagttctcttgaaggtggatgcagtgcccctgcagtgcttgaagtggccgctcattgtccaggaatgtggatgcagtagtcatgcagtggatgcagtgtcccacaaggtggatgcagtaagttgtgatggaggatgcagcgtgcgtgaaggtggatgcagtgatgctgcagtcattgcagtgccccgacttccctgaatgtggatgcagtgcccatgcagtagttgcagtgtcccacaaggtggatgtcgtatgttgtgatggaagatgcagtgcccattgaggttgatgcagtgagcctgtgttgaatgcagtgcacctgcgttgcgacttcagctgtatgcagtgtccctatagtggttgcagtgccaactgcattgtccgagaaattggattcggtgcacaggcattggaagcagtgtcccacaaggtgcctgcagtatgttgtgatggtggaggcagtgcccatgagggtggatgcagtgatcctgcagtcattgcagtgcacctgcatttccacatcagctggaagcagtgtccctacaggggttgcagtgccgccttctgtctccctgaaagtgaatgtagtgcccatgcagtggaggcagtgtccctaaaggtttatgcagtatattgggacggaggatgcactgtgcatgaaggcggatgcagtgtccctgcggtggttgcagggccctgggcattgtgttggaatgtaaattcaggggtcatgcagtgaatgcagtgtctcacaaggagggggcagcatgttttgtcggaggatgcagtgcccatgcagtggatgcagagtaacaaaagtttgttgccgtatgttgtgacacaggatgcagtgcccacgcattggatgcagtgagccggaagtgattgcagtacgccttcagttccaattcagctggatgcagtgtccctgcagtggttgcaatgccctctgccttgttctggaatgtggatgcagtgctcatgctgtggatgcagtgtctcacaatgtggatgcagtatgttgtgatgcatgatgcagtgccaacgaaggtggatgcagtgatcttgcagtgattacagtgcacctgcagtgccacttcagccagatgcagtgttgctgcagtggatgcaaagccaacagccatgtccctgaacgtggatgcagtgcccatgcagtagttgcagtgtcccacaaggtggatgtcgtattttgcgatggcagatgcactgcccacggaggtggatgcagtcagcctgtgctgaatgcagtgcacctgcagtgtgatttcagcttgtgcagtgtcccggcagtggttgcagtgcccagtgcattgtccgagaatgtggatggagtgcccaggtttggatgcagtgtcccaaaatgtgcatgcagtatgttgtgatggaggatgcagtgcccatgaaggtggatgcagtgatcctgcattgttttccgtgcacactgcagtgtccccgaatgtggatgcactgaacaagcagtggatgcactgaacattcagggattgcagtgcacctgcggtgccacttcagctgaacgcaatgttgctgcagtggttgcagagcccactgcagtgtctctgaatgtggatgcagggcccatgcagcctctgcagtgtgacccaaggtggatgcagtatgttgtgaagtaggatgcagtacccatgaaggaggatgcagttatcctgcattcattgcagtgcacatgctgtgtcaatgcatctggatgcagtgtccctgaatttggactctttgctcatgcagtgatgatgtatgttgtcatggagtacgcagtgtccatgaaggcagatgcagtgatcctgcagtgattgcagtgcgcctgaagtgccacttcagctggaatcagtgtcgctaaaggggttgcaatgctgctttctgtgtccctgtaggtgaatgcagtgcccatgcagtggatgcagtgtagcccaaaggttttatgcagtatgttgttgacggagaatgcagtgccccatgaaggtggatgcagtagaccctgggatttgtcctcgaaaggaaatagaagtaccaatgcagtgggatgcagtggaattttcactgattgcagggggcttcgcatggccacaatgcaggatgagggggcgctgcaggtctttcaaacacccctgccgaggccact

SEQ ID NO: 61 - DNA, 820 bp, Equus caballus
gcaggggttgcaggcccatttctgtgtctctgaatatgaatgcagtgcacatgcagtggatgcagagtaccaaaagatggatgtggcatgttgtaacagagaatgcagtgcccatgaatgtggatgtagtgatcctgcagtggttgcagtgtgcatgcactgccacttcagctggatgcattgtccctacagttgctgcagcgcaacctgcactgtccctgaatttggatgcagtgctaatgcagtgatgaagtatgttgtgatggaggaagcagtgctcatgaaggcagatgcagtgatcctggagtgattgcagtgagactgcagtgacacttcagctgtaaccagagtccctgcattggttgcagtgcctgttgcattgtccctgaacgtggctgcagtgcccatacaatggctgcaatttcactgaaggtagatgcagtatattatgacggatgatgcattgcccatgaaggtgcatgcactgttattgcactggttgtcatgccccatttggtgtccctgattgtggatgccgtgcccatgaatgtggatgtggtgatcctgcagttgttgcagtgtccccttcaggttccctgaatgtggatgcagagtccatgcagtggatgcagtgtcgcaaaaggtggatggagtatgttgtctcagaagatgcagtgcccgactgtgaatgcagtgagactgaagtgattgcagtgtgcctgcagtgccacttcaactgtatactctgtccctgcagtggttacagtgctgcctgcattgtcaaagaatgcagatgcagtgcccaggcagtggatgcagt

SEQ ID NO: 62 - DNA, 9720 bp, Equus caballus
agtatgttatgatgaacgatgcagttctcatgatgttggatgcagcgtccctgaagtgctggcagtgccacccacattgtctggaaatgtggatgcagtagtcatgtagtgcatgtagtgtcccacaaggtggatgaagtatgttgtgatggaggattccagggccccatgaagggtggatggagtgatgctgcagtggttgcagtgccccctacagttccctgaatgttgacgcagtggcaatgcagcgtctgcagtgtgacccaagttggatactgtatattgtgaagtaggatcacgtgcccatgaaagaaaatgcagtgatcctgaagtgattgcagtgcacctgcagtgccacttcatctggatgcagtgtccctgcagtggtggcagtgcctgctgtattgtccctgaatgtggatgcagtgcccatgcagtggatggatgcagtgtcccacaaggtgcatgcagtatgttgtgacggaggatgcagtgcccataaggatggatgctgtgatccgggattggttgcagtgcaccatgctgtgtccctgaatgtggatgctgtgaacatgcggtggatgcagtgatcctgcagtgattgcagtgcacctgcatttccacatcagctggaaacagtgtccctgcaggtcttgcaatgccgccttctgtgtccctaaaggtgaattccagtgtccatgcagtggatgcagtgtacctaaaggtgcatgcagtatgttgtgagggaggatgcagtgcccatgaaggtggatgccgtgtccctgcagtggttgcagtgccgcatgcattgtcctggaatgtggatgcagtggccatgcagtggatgcagtgtcccacaaggccgatgaagtatgttttgtcagaggatgaagtgcccatgaggatggatgcagtgaacgtgcagtggctgcaatgccccctacagtttcccagaatgtggatgcagtgcccatgcagtgcatactttgtcccacaacgtggatgcaatatgacttgacagaggatgcagtgcccatgaaggtggatgcagtgagcctgcagtgattacagtgttcctgcagtaccacttcagtgggatgcagtgttgctgcagtggttgcagagccaactgcagtgtccttgaatgtggatgtagtgcccatgcagtgcatgcagtgtcccacaatgatcatagagtatgttttgatggaggatgcagtgcccatgaaggtggatgcagtgtccctgctgtggttgcggtgcccccagcattgtcctggaattttgatgcagtgccaatgcagtgcattcagtgaaatttcagtgaatacagagctcctgcagtgccacttcagctggataaagtgtagcagcagtgtttgcagagccccctccaatgtgcctgaatgttgatgcagtgcccatgcagtgtctgcagtgtgacccacggtggatgcactatgttgtgaagtaggatcgtgtgcccatgaaagagaatgcagtgatcctgaagtgattgcagtgcacctccagtgccacttcagctggctgcagtttccctgcagtggttgcagttccgcattatttgtccctgaatgcagatgcactgcccatgcagtggatgcagagtaccaaaatttgcttgccatatggtatgacagaggatgcagtgcccacgagttggatgccatgacccggcagtgattgcaatatgccttcagtgccacttcagcttgatgcagtgtctttgcagtgttgtcatgcccactgcatagtctggaaatgtggatgccgtgcccaggcagtggatgcagtgtcccagaaggtggatgcagtatgttttgaaggataatgcagttctcatgaaggtggattcagtgtcgctgcagtgcttgcagtgcctaccgtattctcctggaatgtgaatgcagtaatcatgcagtggaaacagtgtcccaaaaggtggatgcagtatgttgtgatggatgatgcagggcccatgaaggtggatgcagtgatgctgcagtggttccagtgccccctactgttccctgaatgtggatgaagtgcccatgcagtagttaccgtgtcacacatggtggatgtcgtatgttgtgatggaagatgcagtgcccacgaaggtggatgcagtgagcctgtgctgaatgcagtgcacctgcagtacgacatcagctggaagcagtgtcacagcaggggtggcagtgtcaccttctgtgtcactgaaggtgaatgcagtgcccatgcagtggatgcagtgtacctaaaggtttatgcagtatgttgtgatggaggatgcagtgcccatgaaggcggatgcagtgtccctgcagtggttgcagtgcccctggcattgtcctggaatgtggatgcagtgctcatgcagtggttgcagtgtctcacaaggcagttgcactatgttatgtcggaggacgcggtgcccaggaaggtggatgcagagatccgccagtggctgcagtgcataatgctgtgtccctgaatgtggatgctgcaaacatgcagtggatacaatgatcctgctgtgatagcagtgcgcatgcatttccacaacatctagaagcagtgtccctgcagggcttgcaatgacggcttctgtgtgtctgaaggtgaatgcagtgcccatgcagtgtatgcagtgtccctgcagtggtggctgtgcccccggcaatgtcctggaatgtggatgcagtggacatgcagtgaatgcagtgtctcacaaggcggatgtagcatgttctgtcataggatgcagtgctgatcaaggtggatgtggtgaaactgcagtggttgctgtgccagctacactttccctgaatgtgaatgcagtgcccatacagagcatgcagtgtctcacaatgtggattcagtatgtagtgacagagaatgcagggcccatgatgtggatgcagtgtccctgcagtggttgcagtgccccttgcagtttccctgaatgtggatgcagtgctcatgcagttgatgcagtgtcccacaaggttgatgccttatgttgtgctggaagattcagtaatcttgatggaggatgctgtgatcctgcagtcattgcagggcaccttcagagccaattcagattgctgcagtttcccttcagttgatgcagtgccccgttctgtgtccctgaatgtgcatgcagatcccattcagtggatgcaaagtaccaaaagttggttgctgtatgttgtgacagaggttgcagtgcaaacgagttggatgcagtgagccggcagtgattgcagtatgccttcagtgccatgtcagctggatggagtgcccctgcagtgcttgcagtgccctgtgcattgtctgggaatgtggatggagaagtcatgcagtggatgcagtgtccctcagggtggatgcagtatgttgtgatggaggctgcagggcccattaaggtggatgcagtgatgctgcagtggttgcagtgccccctacagttccctgaatgtggatgcagtgcccatgcagtagatgcagtgtcccatagggtggatgttgtacgttgtgaatggaagatgctgtgaccacgaaggtggatgcagtcagcctctgctgaatacagtacacctgcagtgcgacttcagctgtatgcagtttccctgcaagggttagagtgcacacttcattgtccaagaacgtggatgtagtgccaaggcattggatgcagtgtcccacaaggtgcatgcagtatgttgtgacggaggatgcagtgcccatgaaggtggatttggttaacctactgtcgttgcagtgctccctacagtttccctgatgtggatgcagtgcctatgcagtggatacagtgtcccacaaggtgcatgcagaatgttgttatggtttatgcagtgccaaggaagctggatgcagtgtccctgcagtgcttgcagtgcccccccacattgtccaggaatgtggatgcaggagtcatgcagtggattcagtgtcccacaaggtacatgcagtgtgttgtgatggaggatgcagggcccatgaaggtggatgcaatgatgctgcagtggttgcagtgccccctacagttccctgaatgtggatgcagtgcctatgcagtagttgcagtttcccacaaggaggatgtcgtattttatgatggaagatgcagtgcccacgaatgtggatgcagtgagcctgtgctgaatgcattgcacctgcagtgcgacttcagctgtatgcagtgtccctgcagtggttgcagcacccccggcactgtcctggaatgtggatgcagtggcatgcagtgcatgcagtgtcccacaaggcggatacagtatgttgtgacggatgatgcagtgcccacaaaggtggatgcagtgagcctacagtcattgcagtgcaccttcagtgctacttagctgaatgcagtgttgctgcagtggttgcagggccaactgcagtgtccctgaacgtggattcagtgcccattcagtagatgctgtgtcccacaatgtgaatgcaatatgttgtgaccgtggagccagtgcccatgaaggtggatgcagtgatcctgcagtggttgcagtgccccttgcagtttccctgaatgtggattcagtgttcatgcagtggatgcagtgtcccaaaaggtgtatgccttatgttgtgttgggggattcattgctcatgaaggaggatgtagtgatcctgctgtcattgcagtgcacctgcactgccacttcagctggatgcaatgtccctgccatggttgcagtgccccgttttgtctccctgaatgtggatgcagagtaccaaaagttggatgaggtatgttctgacagaggaggcagtgcccatgagttggaggcagtgagccgccagtgattgcagtataccttcagagacacttcaactaaatgcagtctccctgcagtggttgcactgccccctgcattgtactggcatgtggattcaggtttcatgtagtggatgcagtgtcccataatgtgcatgcagtatgttgtgacggaggatgcagtgcccatgaaggtggatgcagtctccctgcagtgattgcatttcccacagcattgtcctggaatgtggatgcagtggtcatgcagtggattcagtgtcccacaaggtggatgcagtttgttgtgatggaggatgcagtgcccttgagtgtggatgcagtgatgctgcagtggttgcagtgccccctacagttgcctgaatatggatgcagtgcccatgcagtggataccgtgtcccacaatttgcatgcagtattgcataacagaggatgcagtgcccatgaaggaggatgcagtgtcacacaaggtggatgcagtatgttgtgatggaagatgcagtgaccctctgctgaatgcagtgtgcctgcagtgcgacttcagctgttttccgtgtccctgacgtggatgcagggcccactgcattgtccaagaacatggatgcagtgcccagtcagtggatgcagtgtgccacaagatgcatgcagtatgttgtgacggaggatgcagtgcccatgaagttagatgcagtgatctggcacaggttgcagtgcaccctgctgtgtccctgaatgtggatgtggtgaacatgcagtggatgcagtgatcctgcagtgattgcagtgtgcctgaatttccacatcagctggaagcagtgtccctgcaggggttgcagtgccgccttctgtgaccctgaaggtgaatgctgtgcccatgcattgaatgcagtgtacctaagggtttatccagtatgttgtgatggaggatgcagtgcccatgaaggtggatgcattgtccctgcagtggttgcagtgcccacggcattgtgctgtaatatttatgcagtgcctatgcagtggatgcagtgaaacttcactgatagcagtgcacctgcagtgccacttcaggttcatgcagtgttgcttcagtggttgccgagccacctgcagtgtccgagaacgtggatgtggtgcccatgcagtggatgcagtgtcccacaatgtgcaagcagtatcttgtgacaaaggatgcagtgcccatgatggcggatgcagtgatcctgcagtggtttcagtgccccctgcagtttccctgaatgtggatgcagtgctcatgcagtggatgcagtgtctgacaaggtggatgcattatgttttgacagataatgcagttctcatgatggtggatgcagtgtccctgcagtgcttgcagtgcccaccatattgtcctgtaatgtggatgcagtagtcatgcagtggatgcagtgtcccaaaaggtggatgcaatatgttgtgatggaggatgcagggactatgaaggtggatgaagtgatgctgcattgcttgcattgccccctacagttccctgaatgaggattcagtgcccatgcagtagttgcagtgccacagaaggtggatggaagatgcagtgcccacaaaggtggatgcattgagcatgtcctgaatgcagtgcatctgcagtgtgacttcagatggatgcagtgtccctacactggttgcagtgcacactgcattgtctgagaacatggatgcagggcccacgcattggatgcagtgtcccacaaggtgcatgcagtatgttgtgatggagaatgcagtgcccatgaaggtggatgcagtgatccggcagtggttgcagtgcaccctgctgtgtccctgaatgttgatgttgcgaacatgcagtggatgcagtgaccctgcactgattgcagtgcacctgcatttccacatcagcagggagcagtgtccctgcagggctttcaatgctgccttctgtgtccctgaaggtgaatgcagtgcccatgcagaggatgcagtgtacctaaagatttatgcagtattttgtgacggaggatgcactgcccatgaaggtggatgcagtgtcccacaatgtggatgcaatatgatttgacataggatgcagtgcccacaaaggtggctctagtgagactgcagtgattgcagtgtacctgcagtgccacttcatcaggattcagtgttgctgcagtagttgcagagccaactgcagtgtccctgaatgtggatgcagtgcccatgcagggcatgcagtgtcccacaatgtgcatggagtatgttgtgatggagcatgcagtgcccatgaaggtggatgcagtgatcctgcagtggttgcagtgccccctgcagtttacctgaatgtggatgcagtgctcatgcagtggatgcagtgtccctcaatgtggctgctgcatgttgtgatggaggattcagtgatcatgaaggaggatgcagtgatactgcagtcattgcagtgcccgtgccatgccacttcagctggctacagtgtccctgcagtggttgcagtgcccggttctgtgtctctgaatgcagctgcactgcgcatgcagtggatgcagagtaccaaaagttggttgccatatgtttgcacagaggatgcagtgctcactatttggatgcattgagcctgtagggaaggaagtgcagcttcagtgtgacttcagcaggatgcagtgtccctgcagtggttgcaatgcccccttcattgtcctggaatgtggatgcagtgctcatgcagtagatgcagtgtccctcaatgtggaggcattgtgcagtgctgaattatgcagtgccaatgaaggtgaatgcagtgatcctgcagtgatggcaatgcgcctgcagtgccacttcagctggatgcagtgttgctgcagtggttgcaacgccccctgcattgtccaggaattttgatgcagtgcccaggcagtggatgcagtgtcccacaaggtggatgcagtatgttatgatgaacgatgcagttctcatgatgttggatgcagcgtccctgaagtgctggcagtgccacccacattgtctggaaatgtggatgcagtagtcatgtagtgcatgtagtgtcccacaaggtggatgaagtatgttgtgatggaggatgcagggcccatgaaggtggatggagtgatgctgcagtggttgcagtgccccctacagttccctgaatgttgacgcagtgccaatgcagcgtctgcagtgtgacccaagttggatgctgtatattgtgaagtaggatcacgtgcccatgaaagaaaatgcagtgatcctgaagtgattgcagtgcacctgcagtgccacttcatctggatgcagtgtccctgcagtggtggcagtgcccgctgtattgtccctgaatgtggatgcagtgcccatgcagtggatggatgcagtgtcccacaaggtgcatgcagtatgttgtgacggaggatgcagtgcccataaggatggatgctgtgatccgggattggttgcagtgcaccctgctgtgtccctgaatgtggatgctgtgaacatgcggtggatgcagtgatcctgcagtgattgcagtgcacctgcatttccacatcagctggaaacagtgtccctgcaggtcttgcaatgccgccttctgtgtccctaaaggtgaattccagtgtccatgcagtggatgcagtgtacctaaaggtgcatgcagtatgttgtgagggaggatgcagtgcccatgaaggtggatgccgtgtccctgcagtggttgcagtgccgcatgcattgtcctggaatgtggatgcagtggccatgcagtggatgcagtgtcccacaaggccgatgaagtatgttttgtcagaggatgaagtgcccatgaggatggatgcagtgaacgtgcagtggctgcaatgccccctacagtttcccagaatgtggatgcagtgcccatgcagtgcatactttgtcccacaacgtggatgcaatatgacttgacagaggatgcagtgcccatgaaggtggatgcagtgagcctgcagtgattacagtgttcctgcagtaccacttcagtgggatgcagtgttgctgcagtggttgcagagccaactgcagtgtccttgaatgtggatgtagtgcccatgcagtgcatgcagtgtcccacaatgatcatggagtatgttttgatggaggatgcagtgcccatgaaggtggatgcagtgtccctgctgtggttgcgttgcccccagcattgtcctggaattttgatgcagtgccaatgcagtgcattcagtgaaatttcagtgaatacagagctcctgcagtgccacttcagctggataaagtgtagcagcagtgtttgcagagccccctccaatgtgcctgaatgttgatgcagtgccatgcagtgtctgcagtgtgacccacggtggatgcactatgttgtgaagtaggatcgtgtgcccatgaaagagaatgcagtgatcctgaagtgattgcagtgcacctgccgcgccacttcagctggatgcagtttccctgcagtggttgcagttccgcattatttgtccctgaatgaagatgcactgcccatgccggggatgcagagtaccaaaatttgcttgccatatgcctgctattaggaagcagagcccacgagttgaatgccatgacccggtttgctctgcaatattccttcagtgccacttccacttgatgcagtggcattgacgggttgtcaggttacctgcaaattccggaaatgcgagtgccgtgccccctctgtgtctttttaataccccaataactgtttcaagtggtaaccactacaatgcacctctctgtaagac

SEQ ID NO: 63 - DNA, 9533 bp, Equus caballus
agtgccgatgcagagtaccaaaagttggttgggtatgttgtgacagaggatgcagtgcccacgagttggatgcagtgagccagcagtgattgcaatacagcttcagtgccacttaagctggatgcagtgtagctgcagtggttgcagagccccctgccatgtccctgaatgtggattctgtgcccatgcagtgtctgcagtttgactcagggtggatgcagtatgttgtgaagtaggattcagtgcccatgaagggtgatgcagtgctcctgaagtcattgcagtgcacatgcagtgccacttcatcgggatgcagtgtccctgcagtgtttgacatgcagcctgctgtgtccctgaatttggatgctgtggacatgcagtggatgcagtgatcctgcaatcagtgcagtgaatttgcagtgccacttcagctggctgaactgtccctgcagtggttacattgccccattctgtgtccctgaatgtggatgcagtgcccatgcagcagatgcagagtaccaaaagttggttgccgcatgttgtgacagaagatgcagatcccttaagttggatgcagtgaaccggcagtgatggctgtacgcattcagtgccacttcagttggatgctctgtctctgcagtggttgcagtgcccactgcattgtccaagaacgtggatgcagtgcccaggcattggatgcagtgtcccacaaggtgcatgcaggatgttgtgacggaggatgcagtgcccatgagggtggatgcagtgatgcggcagtggttgcagtgcaccctgctgtgtcactgaatgtgcatgctctgtacatgcagtggatgcagtgtacctaaaggtggatgcagtatgttgtgaagcaggattcagtgcccatgacggatgatgcagtgatcctgctgtcattgctgggcacctgctgtgtcacatctgctggatgcagtgttgctgcagtggttgcagtgcccctgcattgtctgggaatgtggatgcagtgtccagacagtggatgcagtgtcccacaaggtggatgcagtatgttatgacagatgatgcagttctcatgaaggtagatgcagtgtccctgcagtgcttgcagtgcccctcgcattgtccgggaatgtggatgcagtagtcatgcagtggatgcagtgtcccataaggtggatgcagtatgttgtgatggaggatgcagggcccatgaaggtggatgcattgatactgccatcattgcagtgccccctacagtttcctgaatgtggatgcagtgcccatgcagtagttgctgtgtcccacaaggtgggtgtcgtatgttgtgatggaagatgcagtgcccacggaggtgtattccctgaacctctgctgaatgcagtgcacctgcagtgtgacttcagctgtatgcagtgtccctgcagtggttgcagtgcccacagcattgtccgagaacatggatgctgtgcccaggcattggatgcagtgtcccacaaggtgcatgaagtagtttgtgacggaggatgcagtgcccatgagggtagatgcagtgatccaggactagttgcagtgcaccctgctgtgtctctgaatgtggatgttgtgaacacacagtggatgcagtgatcctgcagtgattgcagagcgcctgcatttccacatcagctggaagcagtgtccctgcaggggttgcagttcctccttctgtgtcactgaagctgaatgcagtgcccatgcagtggatgcagtgtacctaaaggtttatgcagtatgttgtgacggaggatccagtgcccatgaagggggatgcagtgtccctcaagtggtagaagtgcccccagcattgtcctgaaatgttgatgcagtgtctatgcattggatgcagtgaatcttcagtgattgcagtgcgcccgcagtgccacatcagctggatgtagtgtccctgcagtggatgcagtatgcctgcatttccacatcagctggaagcagtgtctatgctgtgcttgcagtgccccattctgtgtccctgagtgtggatgcagtgcacatgcagtggatgcagagtacgaaaatgttggttgccgtatgttgtgacagtggatgcagtgtccccgagttggatgcagtgatcctgctgtgattacagtgcgccttcattgccactgcagctgaatgcagtttccctgcagtggttgtagtgccacctgcattgtccctgaatttggatgcagtgcctatgcagtggatgcagtgtccaacagggtgcatgcagtatgttgtgagggaggatgcagtgcacatgagggtggatgcactgatccagcactggttgcagtgcaccctgctgtgtctctgaatgtgcatgctgtgaacatgcagtggatgcagtgatcctgcagtgattacagtgcacctccatttccacatcagctggaagcagtgtcactgcagtggttgcagtgctgccttctgtgtccctgaaggtgaatgcagtgacaatgcagtgtacctaaagttttatgcagtatgttgtgacggaggatgcagtgcccatgaaggtggatgcagtgtccctgcagtggttgcagtgcccctggcattgtgctggaatgtggatgcagttctcttgcagtggatgcagtgtcccacaatgtgcatgcagtatgttgggatggagaatgtagtgcccatgaaaggtgaatgcagtgacactgcagtggttgtggtgccccctgcagcgtacctgaatgtggatgcagtgctcacagactggattcagtgtcccacaacgtggatgccttatgttgtgttggaggataagggatcatgaagcagaatgcagtgctcttacaggtatttgctgtgcatctgcagtgccaattcagctggtttcagtgtcccagcagtggttgcagtgccccattctgtgtctctgaatgtggatgcagtgcccatgcagtggatgcagagtaccaaaagttggttgccatattttgtgactgaggatgcagtgcccacaagttggatgcagtcagccggcggtgattgcagtacgccttccgtgccacttcagctgaatgcagtgtccctgcagtggttgcagtgccccgttctgtgtctctgaatgtggatgcagtgcccatgcattggatgcagaataacccaaggtgtatgcagaatgttgggatgaaagatgtattgcccatgtagggggatgcagtgatcctgcactggttgcagttcaccctgcagtttacctgaatgtgaatgcactgcccatgaagcagatgcagtggtgcccaaggtggatgctgtatgttgtgatgtaggatgcagtgccccgaaggacgatgcagtgatcctgcagtgattgcagtgtgcctgcatttccacatcagctggatgcagtgtaaatgcagtggctgcacgggccacttctgtgtccctgaatgtggatgctgtgcccatgcagcgactgcagtgtgacacaaggtggatgcagcatggtgtgaccgatgatgcagtgcccatgaaggtggatgcagtgtcaactgaagtggttgcagtgcccccggcattgtcctggaatgtggttgcagtagtcatccagtgggtgcagtgtcccaatggtggatgcagtatgtcgtgacggaggacgcagtgccgatgaaggtggatgcggtgatcctgcagtggttgctgaagctgctacatttccatgaatgtggatccagttcccatgcagtagttgcagtgtcccacaaggtggatgcagtatgttgtgaccaaggatgcagtgccgatgaacatggatgctgtgagcctgcagtgattgcagtgtacctgcactgccacttcagcgtgctgcagtttccctgcacaggttgcagtgactcctgcattgtccctgaattttgatgcagtgtgcatgcagtggatgcagtgtccaacaagatggatgcagtatgttatgacagatgatgcagtcttcatggaggtggatgcagtgtccctgcagtgcttgcagtgccccctgcattgtccaggaatgtggatctagtagtcatgcagtggatgcaatgtcccacaaggtggatgcagtatgttgtgatggagaatgcagggcacatgaaggtggatgcagtgagcctgcagtgtttgcagtgcacctgcagtgccccttcggctgtatgcagtgtccctccagtgtttgcaatgccccccgcattgtccaggaatgtggatgcagtagtcatgcagtggattcagtgtcccacagtgtggatgcaggttgttgtgacggaagatgcaaggcgaatgaatttggatgcagtgatgttgcagtggttgcattgccccctacaattccctgaatgtggatgcagttcccatgtagtagttgcagtgttccacaaggtggatgcagtatgttgtgacataggatgcagtgcccaagaaggtggatgcagcagtgccaaagtcacgtgccagctaggcctgcaccaagtacctgtcacacttgaatcacaggtcagcctcacttgaagcacgtgtcagccacactggcataacttgcctgccatgccagaaccacgtgccaaacatgccacaaacacatgtgagccaggctttagcagcaccttggccgtgcatgagccacacctgagccatgtgttagccatgcgtgacaaaagcctgattaatgtgtcagccacatggaagccagtgctgtggcactcctgcatcatgtgagagccatggctgagctatgcctgaaacacgtgtgaatgtgtcatctaccacatgtgacccacacatgtcgtatgtgagccacagctgcaatacaaccaaatcatgtgtgagccctacatgaaccacatgtgagacaccctgaagcacatctgaagcacctgtgaaacacatgtgatcgatgcttgaaccgcacatgaaccgctggggagccacacatgaaacacaggtgagccatgcgggagccacgtgccagccatgactgagtatgcggcagccaggtttcaaacacatgtgagtcaaggtggcagccacatctgtatggcatgtcacacacgtgccaccacatttctgccacacatggatcctgtgcaatgcatgcctgagtcatgggtcagccatgccagagacatttgtcagccacaccagagccatgtttcaaagatgcctgagtctcctgtcagccacccctgtaccacattccacccctgcatgcaccaagcaccagccatccctgaagcacacgaaggccattcatgaagcatgtgtgacccacaccagagtgacatgtcacgcacgcctgtgtcatgtggctacctcacctgagtcatgtgtcagccacacctgaataaactgtgagccacgcctgagtcacgtctcagcagtgccgaaatcatgtgccagcccgtcctgaaccaactgccagtcacacttgaaccacaggtcagcctcactcgaagcacatgtcagccacactgggacaacttgcctgccatgccggaaccacatgccaaccatgccacaaaaacatgtgagccacgcctgagcaacaccacagccatgcatgagccactcctgagccttctgtaatccaagcatgacaaaagccagaatcacgtgtccaccacatgggagccagtgctgtggcatgcctgcatcatctgggagccatggctgagctatgccttaaccactggtgaaagtgtcctctacgatacgtgacccacatgagtcttgtgttgtcaaggcctgaattacaactgaaccatgtgtgagccatgcatgaaccacatgtgagacacccttgaagcacatctaaaccacctgggaaacacacgtgtttgatgcttgaatcgcacatgactcgcaatggagccacacatgaaacacagctgagccatgtgggagccacatgccagccatgagtgagtaatgcggcagccacgtttcagcaacctgtgagtcacgtggaagccacgcctgtacggcatgtcacacacgtgtgaccacatgtctgccacacattgatcctgtgcgatgaatgcctgagtcatatgtcagccatgcctgagacatgtgtgagccacaccagggtcatgtttcacacatggctgtgtcacatgtcagccactcctgaaccacctgccacccatgcatgtaccctgcaccagccaccccgaaccacacgaaggccatccatgagccatatgtaaacaaaacccaggtgacatttcacatccacctgtgtcacgtggccgcctcacctgagtcatgtgtcagccatacctgcataatgtgtgagtcacgtctcagctctgccgttgtcatgtgccagcccgtcctcaacaaactgccagtcacacttaaacaacaggtcagcctcactcgaagcatgtgtcagccacactggcacaacttgcctgccatgcctgaaccacgtgacaaccatgccacaaacacatgtgagtcacgcttgagcagtaccacagctgtgcaggtgagacacatgagccaagtgtgagccatgtgtggcaaaagcctgaatcatgtgtcaaatacgtgggagccagtgctgtggcatgcctacatcacgtgtgagccatggctgagctatgcattaaccactggtgaaagtgtcctctaccatttgtgacccagatgagtcatgcgtgagccacgcctgaattacacctgaaccatatgtgagccatgcatgaaccacatgtgagacacctgtgaaacacatctgaaccacctgtgaaacacacatgttcgatgcttgaaccacacatgaaccgcaggggagccacacacgaaacagagctgagccatgcatgagccacgtgccaatgaccgagtatgtgggagacacgtttcaggaagctgtgagtcacgtgggagccacatctgtattgcatgtcacacacgcgtgacaacatgtctaccacacatggatcctgtgcgatgcatgcctgagtcacctgtcagtatgcctgagatatgtgtgagccacacaagggtcatgtttcacacatgcctgtgtcacatgtcagccatgcctgaaccacctgccagccatgcatgtaccctcaaccagccacccctgaaccaaatgaaggccattcatgagccatatgtgaaacaaacgcaggtgacatgtcatgcccacctgtgtcatgtggccacctcacctgaatcatgtgtcagccacgcctgaataatatgtgagtcaagtctcagccatgctgttgtcatgtgccagcccagcctgaaccaactgccagtcacacttgaactggtcagcctcactcgaagcatgtgtcagccacactggcacaatttgcctgccatgcctggaccacgtgacaaccatgccacaaacacatgtgagtcacgcttgagcagtaccatagctgtgcatgtgcaacacatgagccatgtgtgagccatgcatggaaaaagcctgaatcatgtgtcacatatgtgggagccagtgctgtggcacgcctacatcacatgtgagccatggctgagctatgccttaagcactggtgaaagtctcaatgatatgtgactcacaagagtcctgtgtcagccatgcctgcattacagctgaaccatttgtaagccatgcatgaaccacatgtgagacacccttgaagcacatctaagccacctgtgaaacacacatgttggatgcttgaatcgcacatcacacacagctgagccatgtgggagccacgtcccagccatgagtgagtatgcgggagccacgtttcagcaacctgggagtcacgtgggagccacaccagtacggcatgtcacacacgtgtgaccacatgtctgacacacatggatcctgtgcgatgcatgcctgagtcacgtgtcagccatgcctgacacatgtgtcagccacactagagtcctgtttcacacaggccggagtcacatttcagccacgcctgaaccaccatccacccatgcgtgaaccatgcagcagccacccctgaaccacacgaaggccatgcgtgaaccatgtgtgaagcacacctgtgtgatgtgtcaggcacgcctgtgtcacgtttccacctcacctgagtcatgtgtcagccacacctgaacaacgtgtgaaccatgcctgtgtcaaggctcagccgtgcaaagtcacttgccagccaggcctgaaccaagtgccagtcacacttgaaccacaggtcagcctcacttgaagcacgtgtcagccacactgccaaaacttgcctgccatgtcagaaccacgtgccacccctgccacaaacacatgtgaggcacgcctgaccaacaccacagacatgcatgagccacacctgaaccatgtgtgagccatgcgtgatcaaggcctgtatcatgtgtcagccacatgggagccagttctgtggcatgcctgcatcatatgtgagccatggctgagctatgcctgacccacgtgtgagattgtcctcaaccatatgtgacccagacgagtcgtttgagatcctcatctgaattacacccgaacaatgtttgagccatgaaggaaccccattagagacacccttgaaccacatctgaggaacctgtgaaacacacatgttccatgcttgaactacgaatgaaccacaggggagccacccatgagacagccgagccaggtgtgagccacgtggcagccatgagtgagtatgtgggagccacgtttcagcaacctatagtcccatgggagccacccatgtacagcatgtgactcctgcatgatcacatttccgtaacacatggataatgggtgatgaatgcctgagtcacgtgtcagccacactagagtcctgtttcacacaggccggagtcacatttcagccacacctgaaccaccagccacccatgcgtgaaccatgcaccagccacacctgaaccacatggaggccatgcgtgaaccatgtgtggaccacacctgcgtaatgtgtcagccacgcctgtgtaacgtttccacctcacctgagtcatgtgtcatccatgcacgaacaatgtgtgaaccacgcctgtgtcaaggctcagccacgcaaagtcacgtgcctgccaggcctgaacaaagtgccagtcacacttgaatcacaggtcagcctcacttgaagcacatgttagccacactggcacaacttgcctgccatgcctgaaccacgtgccacccatgccacaaacacatgtgagccacgcctgagcaacaccacagacatgcatgagacacacctgaaccatgtgtgagccatgcgtgatcaaagcctgtatcatgtgtcagccacttggctcccagttatgtggcatgcctgcatcccgtgtcagccatggctgaggtatgaatgaaccacgtgtgagattgtcctcaaccatatgggacccagacaagtcgtgtgagatccacacctgaattacacccgaaccagtgtgagccatgcaggatccacatgggagacacccttgaagcacat

SEQ ID NO: 64 - DNA, 28795 bp, Equus caballus
cactggaacccgtgtctgacacacctgaatcccatgcttgaaacacatgtcagcaatgcctgagtgtcgtgacagacttgcctgagccatgtgccaatcatgccagagccatgccccagtcatgcatgagcctcccctgagacgtgtgtgggccatgtgtgaaaaactcctgaatcatgtgtcagccacacctggcccagttctgaggctcacctaaactccatgtgagccatcactgatccatgcctgcaccacgtgtgagccacacctgaatcacggctcaaacactcctcaaccaaaggggacacacacatgagccatgtgtgagccacaactgagttacacgtgaaccatttgggaaccacacctggaccatgactgaaccacatgaggcacacttgaaccacatgtggaacaagtgtgaagcacacacgttccaggtttgaaacacaggtgaacgacaagggagccactcgagaaacatggctgggacacgcatgagccacgtgccagccacgtccgagtaggtgggagccagttgtcaacagcgagtgagtcacgtgtgttccacacaggaacgacatgtaacagatgcatgaaacacaggtctgccaggctcggataatgtgcggtgaatgcctgagtgacatgtcagccgtgcctgggtcatgtgtcagccacacctgaaacacctgtcacccatgcatgaaccacgcattagcaacccccgagccacgtgaagggccgtgcatgaaccaggtgcaagccacagctgcatgatgtgacaggcacgcctatttcatgtggctgcatcacctgagtcatgtgccagccatgcctgaaaaacgtgtgagcgaagactgactctcatctcagccatgccgaagtcacatgccagccacgactgaaccatgtgccagtcccaatttcaccacacggcagcctcacttgcacgtgtcagccacgctggagccacctgccagccatgccagaaccacgtgccaacaatgctacagacaagtgtgagccacacctgacagcaccacacccatgcatgagccacacctcagcagtgtgggagccatgcgtgacaaatgcctgaatcgtgcgtcagccacatgcgacccagttctgtttcgtgcctgcatcacgtgtgagccttggctgagctgcaactgaaccatgtctgagccgcacctgaaccatgtctgagccatgcctaaatcatgtgtgaatgtctcctgtagcatttgtgacccacactagtcatgtgtgagccatgcctgaattacatcagatccatatgtgagtcacaacaaaacaatgactgagcacatgtgaggcaccattcaaccacatctggaccacatgagaagcacccattttccatgcttgaaccacacttgaagctcaggtgagccacacgtgaaacacagatgaggtatgcatgagccacatgccagcagttagtgaatatcggggcccatgtgtcagcaatgtgggagccacacctgtacgacatgtcccatgtgtgaccacatgcctgccacgcatggataatgtgcaatgaatgcctgagttgcgtgtgagccatgcctgcgtcatccatcagccccgcatcagaaaagtgccggccactcctgaatcacctgtcacccacatctgaaccacatgtcaggcatgccttagccatgtgccaactgtgacacaccaagtggcagccacacagcaagcacgtgtcactgctgcctgtatgaagcatcacataccactggaacccgtgtctgacacacctgaatcccatgcctgaaacacatcagcaatgcctgagtgtcgtgtcagacatgcctgagccacgtgccaaccatgccagagccacacaccagccatgcatgagcctcccctgagaggtatgtaagccatgtgtgacaaactcctgaatcatgtgtcagccacatctggccccggtctgaggtttgcctgaactccatgtgatccatggcagtgcaatgcctgcaccacttgtgagacacgcctgtatcatggctcaaacactcctcaacaatatgtgacatgcacgagccatgtgtgagccacacctgggttacacctgaactatttgggagacacacctgaaccatgactgaagcacatgagacacatttgaaccacatgtgaaacacgtgtgaaacacacatgttcaaggtttgaaccacacctgaaccacaagagagccactcgtgaaacatggctgggccacatgtgagccacatgccagccacgtccgagtaggtgggatccatttgacagcagccagtcagtcacgtgtgagccacacaggaacaatatgtaaaccatgcatgaaacatatgtcaccaggcacggataatgtgtgatgaatgcctgagtcacgtgtcagccatgcttgtgtcatgtgtcagccacccctgaaacacctggcacccatgcgtgaaactcgcaccagacacccctgagcgtcctgaaggccatgcatgaagcaggtgcgagccacagctgcatgatgtgacaggcgcgcctgtgtcatgtggctgcctcacctgagtcatgtgtcagccatgactgaaaattgtgtaagcaactcctgagtctaatctcagccatgccgaaatcacatgccagccatgactgaaccatgtgccagtcccaatttcaccacacaccattctcacttgaagcacgtgtcagccacactggagccacctgctgtccatgcctgaaccatgtgccaacaatgccacaaacaagtgtgagccactcctgacagcactgcagccatgcatgagccacacctcagccgtgtgtgagccatgtgtgacaaaatcctgaatcatgtgtcagccacacctggcccctgtctgaggctcgcctgaactctatgtgagaaatggctgagccatgcctgcaccacgtgtgaaccacgcctgaatcacggctcaaacactcctcaacgatatgtgagacgcacatgagccatgtgtgagccacacctgggttacacctgaaccatttgggagccacacctgaaccatgactgaaccacaagagacacacttgaaccacatgagaaacacgtgtgaagcacgcatcttcaatgactgaaccacacgtgaaccacaatggagccactcgtgaaacatggctgggccatgcatgagccacgtgccagctgggtctgagtaggtggagatatccgtcagcagcaagtgagtcacatgtgtgccacacatgaaagacatgtaacccatgcatgaaacacatgtcagccaggcatggattatgtgtgatgaatgcctgaaacacgtgccagccatgactcgtcatgtgtcagtcacacctgaaacacctggcacccatgcatgaactatgcaccagccacacctgagccacgtgaaggccgtgcataaagcaggtgtgagccacatctgggtgatgtgacaggcatgcctgtgtcacgtggctgcctcaccagagtcatatgtcagccatgcctgaaaaacgtgtgagcgaagactgattctcatctcagccatgcctaagtcacatgccagccacgactgaaccatgtgccagtcccaatttcaccacacggcaacctcataagaagcacttgtcagccacgctggagccacctgtggaccatgcctgaaccatgtgccaacaatgccacagacaagtgtgagccatgcctgacagcaccgcaaccatccatgagccacacctcagctgtgtttgagccatgtgtggcaaacgccggaatcatgcatcagtcacgtgtgaccaagttctgtggtgtgcctgcatcatgtgtgaaccttggctgagctgcacctgaaccatgtgtgaggcatgcctaaatcatgtgtgaaagtctcctgtagcatttgtgacccacacaagtcatgtgtgagccatgcctgaattacatcggaaccatatgtgagtcacaactaaaccgtgcctgagcacatgtgagacacccagcaaccacatctggaacacatgtgaagcacccatgttcaattcttgaaccacacatgaagctcaggtgagccacacgtgaaacacagtgaggtatgcatgagccacatgccagccgtgactgaatatctggggcccatctgtcagcaatgtgggaaccatacctgtatgacatatcccacgtgtgaccacaggcctgccacgcatggataatgtgtgatgaatgcctgagttgcgtgtgagccatgcctgcgtcatgtgtcagccccgcatcagaaaagtgccagccactcctgaatcacctgtcacccacatctgacccaaatgtcaggcacgctggagccatgtgtccactgtgacacaccaagtggcagccacacagcaagcacgtgtcactgctgcctgtatgaagcatcccataccactggaacccgtgttcgatatgccttaatcccatgcccgaaacacatgccagcaatgcctgaatctcgtgtcagacatgcctgagtcacgtggcaacattgccagagccatgccccagcatggcgtgagcctcacctgagacatgtgttagccatgtgtgacaatctcctgaatcacgtgtcaaccacacctggccccggtctgaggctcccctgaactccaggtgagccatggctgagccacgcctgcaccacgtgtgagccactcctgaatcaatcatggctcaaacactcctcaatcataggtggcatgcacatgagccgtgtgtgagccacacctgagttccacctgaacaatttgggagccacacctgaaccatgactgaaccacgtgtggcaaacttgtaccacatgtgaaacacgtgtgaagcacacatcttcaaggtgtgaaccacacgtgaaccacaatggagccactcgtgaatcatggctgggccatgtgtgagccacttgccagccacgtctgagtgtgtgggagcgagcaatgagtcagcctcgagtgagtcacgtttctgccacacatgaatgacatgtaacccatgcatgaagcacgtgtctgccaggcatggataatgtgtgatgaatgcctgagtcatgtgtcagtcatgcctgcatcatgtgtcagccacagctgaaaaacctggcacccatgtgggaaccatgcacctgccacccctgagccatgtgaagactcttcatgaaccaggtgagagccagacctaagtgttgtgacactcacacctgtgtcacccagctgcctcacctgagtcatgtgtcagtcacgcctgaaaaacgtttgagccacgcctgagtctcatctcagccattccgaagtcacatgccagccacgactgaaccatgtgccagtcccaatttaaccacaagccagcctcacttaaagcacatggcagccacgctggagccacctgcctgccatgcatgaaccacgtgccaaccatgacacaaacaagtgtgcgccatgcctgagcagcaccacagcatgcctgagccacacctcatctgtgtgtgagccatgcgtgacaaacgctggactcatgcatcagccacatgcgaccaagttctgtttcatgcgtgcatcatgtgtgagccttggctgagctgcctcagaaccatgtgtgagccatgcccaaatcatgtgtgaaagtctcctgtagcatttatgacccacacaagtcatgtgtgagccatgcctgaattacatctgaatggtgtgtgagccacaactgaaccatgcctgattcacgtgtgaggcacccttgaaccacatctgaagcccatgggaagcacacatgttgaatgcttgaatgacacatgaacctcaggtgagccacacatgaaacacatctgaggcatgcatgaaccacatgccagccatgactgagtatgtgggggacacatttcagcaacacaggagccacacctgtatgacatgtcccacatgtgagcacatgcctgccaggcatggataatgtgcgatgaatgcctgagtcacatgtgagcaatgcctgtatcatgtgtcagccctgcatcagtaaagtgccagccacagctgcatcaccctacacccaaatcagaaccacctgtcagccacgcatgagccaagtgtcaactgggacacaccgagtgacagccccacagcaatcacgtgtcactgtggcctcaacgaagcaccacacagcactagaacccgtgcccgacacacctgaatcccatgcctgaaacgcatgtcagcaatgcatgagtgttgtgtcacacatgcctgagccatatgtcaaccattccagagccacaccccagccatgtgtgagactcacctgagacatgtgttagccttgtgtgacaaaatcctgaatcatttgtcagccacacatgtcccaggtctgaggcttgcctgaactccatgtgagccatggctgaggcatgcctgcaccacgtgttagccacgactcaatcacggctcaaacactcctcaaacatatgtgacatgcacatgagccatgtgtgagcaacacctgagttacacctgaaccatttgggagccacacctgaaccatgactgaaccacatgagacacaattgagtcacatgggaaacacgtgtgaagcacacactttccaggtttgaaccacacgtgaaccacaggggagccactcgtgaaacatggctgctcaatgcatgagccacgtgccagccacttccgagtaggtcagagccatttgtcagcagcgagtgagtcacgtgtgtgccatacatgaaggacgtgtaacccatgcatgaaacacatgtctgccaggcacgaataatgtgtgatgaatgcctgagtcacatgtcagccatgcctgcgtcatgtgtcagccacccctgaaatacctggcaccccttcgagaaccgtgccccagccacccctgagccacgtgaaggccatgcatgaagcgtgtgtgacacaaagctgcatgatgcgacaggcacgcctgtgtcacgtggctgactcacctgaggcatgtgtcagccattcctgaaaaacgtgttagccatgccaaagtcacatgccagcaacgactgaaccatgtgccagtcccaatttcaacacacgccagcctcacttgaagcaggtgtgagagacactgtagccatctcccagccatgcctgaaccacgtgccaacaatgccaaatacaagtgtgagccacgctggagcagcaccacagccatgcatgagccacacctcagccgtgtgtgagccatgcgtgacaaacgcctgaatcatgcatcagccacgtgtgacccagttctgtggtgtgcctgtatcacgtgtgagccttggcagagctgcgcctgaaccatttgtgaggcatgcctaaattgtgtgtgaaagtctcctgcaggatttatgacacacgcaagtcatgtgtgagccatgcctgaattacatctgaaccgtgtgtgagccacaactgaaccatgcctgaaccacttgaggcacccttgaaccacatctggaacacatgtgaagcacccatgttcaattcttgaaccacacatgaagctcaggtgagccacacatgaaacacagctgaggcatgcatgagctacgtgccagccatgactgagtatgtggaggccacatttcagcaacatcgagccacacctgtacaacatgtcccatgtgtgaccacatgtctgccatgcatggatgatgtgcaatgaatgcctgagtcacgtgtgggccatgcctgcatcatgcgtcagccccacatcagaaaattgccagccacacctgaatcacctgtcacccacatccaaaccacatgtcagccacgcctgagccatgtgtcaactgtggcacaccaagtgtcagccacacagaaatcacgtgtcactgtggcctcaacgaagcatcccataccactggaaccctgtgcgacacgccttaatcccatgcctgaaacacatcccagcaatgcctgaatctcgtgtcacacatgcctgagccacgtggcaacattgccagagccatgccccatcatggtgtgagcctcaactgagacaagttttagccatgtgtgacgaactcctgaatcatgtatcagacacacctggcctcggtctgaggctcacctgaactacacgtgagccatggctgagctatgccttaaccactggtgaaagtgtcctaaacgatatgtgacccacaagagtcgtgtgtcagccacgcctgaattacacccgaaccatgtgtgagccatgcatgaaccacatgtgagacacacttgaagcatatctaaaccacctgtgaagcacacatgttcgatgtttgaatctcgcatgacccgaaatggagccacacatgaaacacagctgagccatgcatgagccacgtgcaagccattagtgagtatgcgggagccaagtttcagccacctgtgagtcacgtgggagccacaccaagtcccagtcacacttgaaccacatgtcagcctcacttgaagcacgtgtcagccacactggcactacttgcctgccatgactgaaccacatgccaacaatgccacaaacacatgtgaacagtgcctgagcaacaccacagctgtgcatgagccactcctgaaccaggtgtgagccaagcatgacaaaagcctgaatcatgtgtcagatacgtgggagccagtgctgtggcacacctgcatcacgtgtgagccatggctgagctatgcctgaaccacctgtgaaagtctcctctaccatttgtgtcacatgagtcgtgcgtgagccacgcctgaattacaagcaaaccatgtgtgagccatgcatgaaccacatgtgagacacccttgaagcacatctgaaccacctgtgaaaaacacatgatcgatgtttgaacagcacatgaaccgcatgggagccacacatgaaacacagctgagccttgcttgagccacatgccaggcatgactgagtatgcgggagccatgttccagcaacctctgagtcacatgggagccacacctctacagcatgtcacacacgtgtgaccacatgtctgccacacatggatcctgtgcgttgcatgcctaagttacatgtcagccatgactgagacatgtgtgagccacaccagggtcatgtttcacacatgcctgtcacatgtcagccatgccttaaccacctggcacccatgcgtgaaccctgcagcagccacccctctaccacacgaaggctattcatgagccatgtgtgaaccacacccaggtgacatgtcaagcatgcctgtgtcacatggccaccactcctgagtcatgtgtcagccacacctgcatgacgtctgagccacgcctgagtcaggtctcagccatgtcgatggcatgtgccagccaggcctgaaccaactgccagtcacactggaaccacaggtcagcctaattaaagcacgtgtcagccacactggcacaacttgcctgccatgccagaaccacgtgccaaccatgccacaaacacatgtgagccaggctttaacaagacagctgtgcatgaggaacacctgagccatgtgtgagccatgggtgacaaaagcctgactcatgtgtcagccacatgggagccagtgctgtggcacgcctgcatcacgtgtgagccatggctgagctatgcctgaaccacgtgtcaatgtgtcctctaccatatgtgacccagacgagtcctgtgtgagccacgcctgaattgcatccgaaccaagtgtgagccatgcatgaaccacaagggagacacccttgatgcacatctgaacgacctgtgaaacacacatgttcgatgcttgaatcgcacatgacccgcaatggagccacacatgaaacacagctgagccatgtgggagccacgtcccagccatgagtgagtatgtgggagccatgctgcagcaacctgtgagtcacgtgggagccacacctgcatggcatgtgacacacgtgtgacaacatgtcttctacacatggatcctgtgtgatgcatgcctgagtcatgtgtcagccttgcctggaacatgtgtgagccacaccagggtcatgtttcacacatgactgtgtcacatgtcagccacgcctgaaccacctgccacccatttgtgaaccctgcaacagccacccctggaccacacgaaggccatgcatgagctatgtgtgaaccacaaccaggtgacatttcacgcatgcctgtgtcatgaggccgtctcacctgagtcatgagtcagccacgcctgcataacgtgtaagccatgcctgagtcaagtctcagccatgccagcgtcacatgccagcccagcctgatccaactgccagtcacacttgaaccacaggtcaaactcactcgaagcacgtgtcaacccactggcacaattcacctgccatgcctgaatcacgtgacaagcatcccacaagcacatgtgtgtcacgcttgtgcagtaccaccactgtgcatgtgccacacatgagccatgcatgagccatgcatggcaaaagcctgaatcatgtgtcagatacgtgggagacagtgccctggcatgcctgaatcacatgtgagccatggccgagctatgcctgaacaacgtgtgaaagtgtcctctaccatttgtgacccagacgagtagtgcatgagccatgcctgaattacacctgaaccatgtgtgggccatgcatgaacaaaatgtgagacaacctttatgaacatctaaaccacctgtgaaacacacatgatcgatgcttgaactgcacatgacccacaagtgagccacacgtgaaacaaagctgagccatgcgtgagccacgtgccagccatgactgagtatggggaggccacgattagcaacctgcgagtcacgtgggagccacacctgtatgacatgtaacacaggcatgaccacatgtttgccacacatggatcctgtgctattcatgcctgaggccattcagccatgcctgagacatgtgtgagccacaccagggtcatgtttcacaatttgcctgagtgacatgtcagccacgcctgaaccacctgccacccatgcatgaaccctgcaccagccacccctgaactacatgaaggcctttcatgaagcatgtgtgaaccacacccgagtgacgtgtcacgcatgcctgtgtcacgtggccacctcacctgattcatgtgtcagcaacgcctggataacatgtgagccacgccagagttacgtctcagcaatgccgaagtcacgtgccagcccagcctgaaacaagtaccagtcacacttgaaccacaggtcagcctcacttgaagaatgtgtcagccacacgggcacaacttacctgccatgctggaaccaagtgcaaaccatgccacaaagacttgtgagacacacctgagcaacaccacagccatgcatgagacactcctgagccttatgtgagccaagcatgacaaaagcctgaatcacgtgtcggccacattggagccagtgctgtggcaagcctgtatcatgtgtgagccatggctgaggtatgcctggaccacgtttgaaagggtcctttacgatatgtgacccacaggagtcttctgtgagcaacgcctgaattacacctgaaccatgtgtgagccatgcatgaaccacatgtgagacaccattgaaggacatctgaaccatctgtgaaacacacatgatcgatgcttgaaccgcacatcaaccaaaggggagccacacatgaaacacagttgagccatgcatgagccacgtgccagccatgactgagtatgcgggagccacattgcagcaacctgtagttatgtgggggccgcccatgtacggcatgtgactcctgcatgatctcatttccgtcacacatggataatgggcgatgactgcctgagtcatgtgtcagccacaccagagtcctgtttcacacatgccggagtcacatttcagccacgcctgaaacacctgccacccatgcgtgaaccatgcaccagccagccctgaaccacatgaaggccatgcatgaaccatgtgtgaaccacacctgtgtgacgtgtcaggcacgcctgtgtcacgtttccacctcacctgagtcatgtgtcagccacgcctgaacaacgtgtgaaccacacctgtgtccaggctcagccgtgccaagtcacgtgccagccaggcctgaatccagtgccagtcacacttgaaccacaggtcagcctcacttgaagcacgtttcagccacactggcacaacatgcctgccatgcctgaaccatgtgccacccatgccacaaacacatgtgagccacgcctgaccaacaccacagatatgcatgagccacacctgaaccatgtgtgagccgtgtgtgaccaaagcctgtatcatgtgtcagccacaggggagccagttctgtggcacgcctgcatcacttgtgagccatggctgagctatgcctgaaacacgtgtgagagtgtcgtcaaccatatgtgacccagacgagtcatgtgagatccacgcctgagttacacccgaaccatgtgtgagccatgcaggaaccacatgggagacacacttgaaccacatctgaagaacctgtgaaacacacatgttccatgcttgaaccacgcataaaccacaggggaacgacccatgagacccagctgagccatgtgtgagccacgaggcagccatgactgaatatgtgggacccacgtttcagcaacctgtagtcacgtgggagccacccatgtatggcatgtcactcctgcgtgatcacatttcaatcacacatggatactgggtgatgaatgtctgagtcacatttcagccatgcctgacacatatgtcagccagaccggagtcctttttcacacatgccggagtcacatttcagccacaactgaaccacctgccacccatgcatgaaccatgcactggccacccctgaaccacacgaagaccatgcttcaaccatgtgtgaaccccacctgtgtgacttttcaggcacacctgtgtcacgtttccacctcacctgagtcatgtgtcatccatgcctgaacaccgtgtgaaccacgcctgtgtcaaggctcagccacgcgaagtcacttgccagcccagcctgaaccaagtgcctgtcacacttgaaccacaggttagcctcatttgaagcccgtgtcagccacactggcaaaacttgcctgccatgcctgaaccacgtgctacccatgccacaaacacatgtgaacatcgcctgagcaacaccacaggcatgcatgtgccacacctgacccatgtgtgagccatgcgtgaccaaagcctgtatcatgtgtcagccacatgggagccagttctgtggcatgcctgcgtcacatgtgagccatggctgaggtatgcctgaatgtggatgctgtgaacatgcagtggatgcagtgaacctgcagtgattgcagtgcgcctgcatttcctcgtcagctggaagcagtgttgttgcagttgtcacagtgcagccttctgtgtccctgaatgtgaatgcagtgcccatgcagtggaggcagtgtacctaaaggtttatgcagtatcttgtgacggaggatgcagtgtgcatgaaggcagatgcagtgtccctgcagtggttacagggcccccggcattgtgctggaatgtgaatgcagtggtcatgcagtggatgcagtgtctcacaaggtggatgcagcatctttttctgtggatgcagtgcccatgaaggtggatgcggtgaacctgcagtggttgtagtgccccattctgtgacgctgaatgtggattcagtgcccatgcagtggaggcagtgtcccacaatgtgcatgcagtatgttgtcacggaggatgcagtgcccatgagggtggatgcactgatcctgcagtggttgcagtgccacctgcagtttacctgaatatggatgcagtgctcattcagtggatgcagtatccctcaaggtggatggcttatgtggtaatggaggattcagtgatcatgaaggaggatacagtgttcctgcagtcattgcagtgcacctgcagggccacttcagcaggctgcagtgcccctgcagtggttgcagtgcctcgttctgtgtccctgtctgtggatgcagtgcccacgagttggatgcagtgagccaacagtgattgcagtacgtcatcatgccacttcagctggatgcagtgtcctgcagtggttgcaatgccccctgcattgtcctggaatgtggatgcagtgttcactcagtggatgcagtgtcccaaaatgtggaggcattgtggtgtgttgtagtatgcagtccagatgaaagtgaatgcagtgttgctgcagtgattgcagtgtgcctgcagtcccacttcagctggatgcagtgttgctgcagtggatacagtgccccctgcattgtctgggaatgtggatgcactagtcatgcggttgatgcagtgtcccacaaggcatcacatgtgagccatggttgagctatgcctgagcaacatgtgagagtgtccccaaccatatgtgacccagacgagttgtgtgagatctacgcctgaattagacccaagccatgtgtgagccatgcaggaaccacatgggagacacccttgaaccacatctgaagaaccagtgaaacacacatgtttgatgcttcaaccacgcatgaaccacaggggagccacaaatgaaacacagtgtagacatgcgtgagccacgtggcagccatgactgagtatgtgggagccatgtttcatcaacctgtagtcacgtgggagccacccatgtacggcaggtgactcctgcgtgatcacctttacgtcactcatggatactgggtgatgaatgcctgagtcacgtgtcagccatgcatgacacatgtgtcagccacaacggagatctgtttcacatatgccggagtcatatttcagccacgcctgaaccaccttccacccatgcgtgaaccatgcaccaggcacccctgaaccacatgaaggccatgaatgaaccatgtgtgaaccacacctgtgtgacgtgtgacgcacacctgtgacacgtggccacctcacctgaaaacgtgtgatccacgactgagccacgtctcagccatgccgaagtcacattccagccaggcctgaaccaagtgccagtcacacttgaaccacaggtcagcctcacttgaagcacgtgtcagacacactggcacaacctgcctgccatgcctgaaccacgtgccacccctgccacaaacacatgtgagccacgcctgagcaacaccactgacatgcgtgagccacacctgaaccatgagtgagccatgcgtgatcaaagcctgtataatgtgtcagccacatgggagccagttctgtggcatgcctgcatcacctctgagccatggctgaggtatgcctgaatgtggatgctgtggacatgcagtggatgcagggatcctgcagtgattgcagtgcacctgcatttcctcaacagctggaagcagtgttgctgcagtggtcacagtgccgccttctgtgtccctgaaggtgattgcagtgcccatgctgtggaggcagtgtaccttaatctttatgtagtatgttgtgatggaggatgcagtgcgcatgaaggctgatgcagtgtccctgcagtggttgcagggcccccagcattgtgctggaatgtggattcagtggtcatgcagtggatacagtgtctcacaaggtggatgcagtatgttatgacggatcatgcacttctcatgaaggtggatgcagcgtaccagcactgcttgcaatgccacctgcattctccgggaatgtggaagcagtagtcatgcagtggatgcagtgtcccacaaggtggatgcagtctgttgtgatggaggatgcagggcccatgaaggtggatgcagtgatgctgcagtgcttgcagtgccacctacagttggctgaatgtggatgcagcgcccatacagtagttgcagtgtcccacaagatggatgttgtatgttgtgctgggagatgctgtgcccacgaaggtggatgcagtgagcctgtgctgaatgcagtgcgcctgcagtgcgacttcagctgtatgcagtgtccctgttgtggttgcagtgcacactgcattgtccaagaacttggatgcagtgcccaggcattggatgccatgtcccacaaggtgcatgcagtatgttgtgacggaggatgcagtgcacatgaaggtggatgcagttatccggcatggttgcagtgcaccctgctgtgaccctgaatgtggatgctgtgaacatgcagtggatgcaatgatcctgcagtgattgcagtgcacctgcatttccacatcagctggaagcagtgtccctgcaggggttgcagtgctgtcttctgtgtccctgaaggtgaatgcagtgcccatgcagtggatgcagtgtacctaaaggtttttgcagtatgttgtgacggaggatgcagtgcccatgaaggtggatgcagtgtctctgcagtggttgcagtggcttcagcattgtcctgcaatatgaatgcaggggtcatgcagtggatgcagtgtctcacaaggcggatgcagtatgttttgtcggaggatgcagtgcccatggaggtgtatgtggtgaacctgcagtggtggcagtgccccctacagtttccctggatgtgtatgctgtgcccatgcagtgcctgcagtgttgcacaaggtggatgcagtatgttttgacggaggattcagtgcccaccaagttggatgcaatgagcctgcagtgattgctgtgcacctgcagttccacttctgctggaagcaatgttgatgcagtggtggcagagccaactgcagtgtccctgaacgtgtatgcagtgcccatacagtggatgcactgtcccacaatgtgcatgcagcatgttgtgatggaggatgcagtgcccataaaggtggatgcagtgatcctgcagtggttgcagtgtcccctgcagtttacctgaatgtggatgcagtgtccctcaaggtggatgccttatgttgtgatggagtatccagtgatcatgaaggagcatgcagtgatcctgcagtcattgcagttcacctgcagtgccacttcaggtggctgcagtgtccctgctgtggttgcagtgccccgttctgtgtccctgaatgtggatgcagtgcccatgcggtagatgcagtgtaccaaaagttggtgtccgtatgttgtgacagaggatgcagtgcccacgagttggatgcagtgaggcagcagtgattgcagtacgccttcagtgccacttcagctggatttagtgtccctgcagtggttgcaatgcctgctgcattgacctggaatgtggatgcagtgcccaggcagtggatgcagtgtcacagggtgggtgctgtatgttccgttggatgatgcagttctcatgagcgtggatacaatgtccctgcagtgcttgcagtgtcccccacattgttcgggaatgtggatgcagtagtcatgcagttgtcgacgaaaataatccatatccaatctataaatgagaatttgggtgagttaattctgagctcaaatctgaagattataacccgggagagtctttccacaaaggaacagagcactccaatgaggtgaggggtatacagtgtcgttagataccctcaaagaggatgtttcacatatgattggaatgtctcttttacaattgtcgtgagactactctgttggcacagcgattgatggaaatagcaggtaggtcttctgccttggtgaacacagcagggtggcagtctgttgtctccagttgggtggtcacagctgagctgggaggtgagtgcagcaatcagatcctagcctaaggaaaaatgctaatgtcggggagaagttgcatctttatctcaagggcctttgttctggccataggaaatgtctaagcagatatgcaatgcatgctcaatagccagccaggcccttttggaggaaaaaaagaagtcagccctaattagttttataccaaatgtcttcctcatatactccaatatatcctattgcttgccaattttatttgtcatttccctcttttgatctctaatcttttgatagaaagcatttatgatcaaatattgtccctcggtgccagggtggttgcttcctgccctgggtccatcatgtccctcggtgctaggcttttatcttatttatttgcctagccgtccactttggggggaaattgtggacaagcatggaagtatatttattaacagaggaagcatttcatatgttatgtaattaatttagattgttgcacaaacattgcatatgcacttttctatgacaccttgcatttacattgtatatgattatagaagaagtacagaaacgataagaacagcatttttgaaaggattagtctgaaattaattcttagtcatagtccatatcagaaaaggaaatttgtccagggttataagacagactgatcatctcaagctgttgagcaatcattactttagtttgtatgctactcttacaacactgagtaaagaaaacaacaagtagtttgaatattatgaccagtacaaggattccaataagtaatagaaataagaattccaatccggatttaaaaagggaacaggtactgaaagggaaccaatgaaacaaatcaaactaggtgcaggatcacataaggcatccacctgctacttcatgtgctttagcagagatgacacattggaagattcatcaggtataaaaatacagcattcagtctgaatgattgcacacgtgtcaccttgagatgctgtaagaatatctaaggccattctattttgaaggacagcctttcgcattaaagtcatttcagtatttaataaggctattcctgcttgactatcattaagggcttgttgagtaaatttagtcagagcttctatatgtaatatgacatcttctagccccaaggaaggagcaaacatagctgcaaatacagtcataccagtgaaacactgaacaagcccatctggccttaaagagagggagattggcaataggtttttaactcagcctgactccttccctgcttttaaaggaaactcagggtgaagtgttttagccatccaggcagtagccaaggccaaagatttgttccacataaccattgagttccattaggagtcactcgataaattcctggccttcaagatcagtctgttccaaattcatcactttaagtatgatagcattccaaacaattataaaataggtatacagcttaagcataacaaaggtttaaatgaggagatagaaggttgggaatacaggcctggtccggagtcttgggacagctgtctacaacagatgtcgtcttcttctcctcctggtttggtccttttggacagggctgcaaacagtcttatttgatgtctctttcaataaataaattcttcaggttacagtccatgatcctaagttctgggacttctctgtgaaagaatcagctaaaatctttcatttcttttaagcaccacaataagaccatgaaaacaatgtaatacatcccttaagcaaagctggttcatatatttcttcatttaattgcataggctgttctattatctaaaaaggagacagccgatgtttacaaaaagtatagatctaagattaaagagcactagcataagagcttttggccatgagagagtaaatgttcctgaaagcttgccaattaagttttggttgtgccatagttccttttaacaatactgaggattgaggatggtaggcacagtagaaatgctgcaatattggccaaacattacaaatagatttgagtttccccagtcactgtgtaactcgggaggaattcctcaaacaggaatttattctttttgatgataatttacctaaagccatcgctcttctgcaaggaaaggcctcaaaacaatgtgagaacgtacagatcattacaagatatgtttatccttgagatggtggcatttggacaaagtccaattgccatacctcaaagggtcccttaggaagggaaagtggccttgtgacccatggagtgggtttcttattgggcccgaaccacatctgcgagggggtgtcaaaaattcccccttttgactgccatatctgtttctcttgttccgtggcaatttcttgagcctgtagaaggaaatcttttactgggttagcagagttaacagaaagtagcaggcattcttgaggctagacagtgtaacatccttacttatcatttaagtaagactcatttgtaaaccaaattaaacaatagaatgcagtcgtggtcttgtctcccttgtgatgctggaagcaaggtaacaaggttaatggttggagcaaattataaattagttcctgcttccagggggcagacagtcaagaagacttctagatgtcagagtcaaagcatctgtttgcagcgtgaaaggtctctggtgatgtcatcgggcattcaggtatctttttgagtggcttacagcttacacagcaacagagaggaagctctcttaagtttctatcaagttgttcagcttcagtttgcaaggtttcaggaaaaagagcatgttcaattctcaatgattccaaatgaaaatgagggaaaaattgaaaacattagtttggagatttgtaaccagatatttcagtagaagaattcaggatgcagttcacttcacaggtagaaaaagcctcaaagacaagtaacagaactaggatctaatatccacaaatgcgtattataatttttcactgaaacaattcttctctctaaaatcaccctcatttttaccaaagatggtcaagttaagactaattggtttgccaaaataagtttagtttcaagaaacttggcccgattatttacataagtgcagcaagaatagcaattgatcatataggctcttaaatctgctttgctggaatttttttatgaggaatctcagattgaactttaaagacttctcgaggccagaaaagccaagccaaggatttgtgccatcaggccttgcctgcaataccttagatttgggtgaatttctctcctttcttgagattccccaaaatatttcgaggttcatcgcacctgccagataagcaagcttccttacttgccaggtaagattgctggaatctctctctgtaaagcaaggtaccaggcccatatttccaagtggctttatttccagaaagtcaaccttattcctcaaaggcagtattgtcatatctgagtctgtatctttctctcaaacatgacattccagtcaaagttttggtaagataacaaatgtgtcctgttacaaggagaacagattcttattgaacttatgcaaataactatattgccacgaaataaccatactccctcacaaagagtttccaaattctggagggatcaggtagggagaaaaagataaatgtttctgttttgctcacaaaggtataatttcactgattgctataagacatggttagcataagagaaaagatttccttaaatcggagaaaacaaaacaatacatcaaaaacaatatttcaaacaaaagtcgtaaaaaaaattataatcatcctcagttcattcagtcctgtataaccggttcttgatcttaatctctgttagcagttttgttttttaacattaaaactcatttgcttaattggatttactttaatcttagtctacttgaccaggcataaaactcctttcagaatttgtccttcacaaaccttctacaactttctttttgccttcagaatttgtcccatgctttccttcttcccttctagtacattaggacaaatttatctttcttaaccaaccaaacaaaaatattttcattctttatacattttttactgaaaacatacattttaactttccttgaatacagagctgttttccttattaatttccagtagctttaattagaacttttaaccattaacagacaaaaggtaagcaattatgaattgtcttttatatcagcattctaaacacttcataatttctaggaacacatcattttacagtaaaagacccaaagacttttagcatctctgcaataaaaaccaaaagcagataaacttagatgtttaggaacgtttgttctatccaatccaaaaattacccagatactcagatttttatcatttaacttaacttggcaaaactcaagattgttaccaaaaagaagttgaaggtttttttcccccaatatacagaccataaaacagttattgtacctacttttatctatttaaatcgtttgtttccaacacttatgttcagattacctacgaatgcctcatgaaacattagacaaaactggtcctcatttaaagctattattttgctgacgaatttctaacagacaacatgaacttatttgactagtaaacccaggctgcatgcctgcatcatatgcaaattctgacaacaagactattttcaatcaaaccaagaaacttaaacaagctttcatttaccaaaggttaattcacaagactttaactttgaaagatactgggttaatttctactacatttagaatttatgtaggcacttactttaagccaaaactcttgatttctcagaaactgggttttaactcaaattacattccaggttgatctacctgtccaactgcatcacaaaggcacagagaaacccaagttttcgattttacagaaggtccaggttctggtcaggtccagcctgaacttaacctcgacttggtgacaacagaagagatgaggagcaaaacagacaaagaaaagatgatatcagacctcgccctcatggcctcttccagagggttatcaagataaaagtcacacaacagttcccatgctgggcacacaaccccagcaggacagttcacagaataaatcacaggtcccctacccctataactgactcagtaggtgactaaaacactcaatgtgtcaactgtcaagagagggaaccacacttagggttgctggggtgatcaggcccagaaacccaaagttggggctcccaggggtggagccttttactctttaaagatttctttgtttcccagttgcaaagctcaaaaggaggcgaaaatggccattgtaactctaagagagatgaagacatttgggttagttctattcagaaacactttttgtaagcgcttactttaagtcaatggaatagagctctttagaaaagaagaagatgagctctgagactccaaaagcagctgcagaggagatggaagggataaacggggtgggacagtttctggcttcttatcctttttttaaattcagatacagtctctgccaatttacggttcatctcctgtaaagaattcactttatcattattacgttctgaagcctctaaatgccaatcataataagcttcccattcttttgctttagttttagagccagctctttctacttgtgcacacaaatacagtagctttgagatatcgaacattccccactttgcccacttaagtcattcttagttaatccttcccattttgttagatacttgcaagcattggttccacacagcaaaccagctggagttccattgggaggtcgtccatccgggagctggccggctttaaaaagcacggttttcccattttctttttgcttttctgtttttgttttttgttttttaaaataaagtctgaacaacttctaaggacagtgtagtgggtcagaagtgtgctgcttgtgagtgttactccccatagaaaggtcgtaaacactctcttacatgcctcggtttttcctctgggtctaaaaccaccgtggggctcggaagcatgggtgaccagcccttatgtgcgcatccctggacgagcctgtaattaattaccttgaatgagagtggagttccctatgggactgctgcacgtcgcgaggattgatcctctgacactcctgctgaggtccttagtcaactaagggtgccttttggtaaaggctgggaggagcaagtgtcccttttctttggagctgaagacattcagtctttcatttctctatcaagcagattgttcagactttataaatataattctttccaattcaaagccaaattaaaaaggacaaccaacccagctcactccaagctcctctaagcccctgaggcttaggaattctctctaggtttttctctacctaggaactgtacaagtacccctcaaaacctgtagtcttaagaacttacccagctcatataaactcttggaccatcaacttaaagtaaggaggtctgggtttcaggagaactcacaaaggtcacctgaagaatgcagtgatccggggggctcaatgggcccttattggtaccaaatgccagttcagtgtagattccaggtggcctgcagtgggcttctctgaaatcctgccaactacaccaagaacagtcgaagaaaataatccatatccaatctataaatgaaaatttgggtgagtttattctgggcttaaatctgaggattataacccaggagagtctttccacaaaggaacaaagcactccaaagaggtgggggggtatacagggtcgttatataccctcaaagaggatgtttcacatatgattgaaatgtcccttttacaatagttgcgagactactctgtaggcacagcaaaagatggaaatagcaggtaggtcttctgtctcagtgaacacagcagggtggcagtctgttgtctccagttgggtggtcacagctgagctgggaggtgaatgcaaaaatcagttcccagcctaaggaaaaatgctaatgtcggggggaagttgcatcttaatctcaacggactttgttctggacataggaaatgtctaagcagatatgcattgtgtgcacaatagccagtcaggaccttttggaggaaaaaaagaagtcaggccgaattaggtttataccaaatggcttcctcatatactccaatatatcctattgcttgccatctttatttgtcacagtggatgtagtgccccccgcattgtccagcaatgtggatgcagtagtcatgcagtggatgcagtgtcccacaaggtggatgcagtatgttgtgacgtatgatgcagtgcccatgagggtggatgcagtgatctggctttggttgcagtacaccctgctgtgtccatgaatgtggatgctgtgaacgtgcagtggatgcagtgctgcttcagcaggatgtagtgttgctgcagtggttgcagtgccccctgccttgtcagggaatttggattcagtgcccaggcagtggatgcagtgtcccacaatgtggatgcagtatgttgcaatggaggatgcagtgcctgtgaagttgaatgcagtgattctgcagtggatgcagtgtcccctacagttctctgaatgtggattcagtgcccatggagcagttgcagtgtcccacaaggtggatgtcctatgttgtattggaagatgcagtgcccacgaaggtggatgcagtgagcctgtgctgaatgcagtgcacctgcagtgcgacttcagctgtatgcagtgtccctgcagtggttgaagtgcatgctgcattgtccaaaaacgtggatgcagtgcccaggcattggatgcagtgtcacataaggtgcatgcagtatgttgtaacggatgatgcagtgcccatgaatgtggatgcagtgtccctgcactggttgcagtgcccctggcattatcctggaaggttgatgtagtgctcatgcagtggatgcagtgtcctacaatgtggaggcattgtggtgtgttgtagtatgctacaccgatgaaggtgaatgctgtgatctgacagtgatggcagtgcccctattgtgccacatcagctggatgcagtgttgctgcagtcgttgcagtgccccctgcattgtccaggaatgtggatactgtgcccaggcagtagatgcagtgtccgagaaggtggatgcagtatgttatgacggatgatgcagttctcatgaacgtggatgcagtgttccggcagtgcttgcagtccccggcgcattatccgggaatgtggatgtagtcgtcatgcagtggatgcagtgtccctgcagtggttgcagtgcatctgtctgcgtggctgaatgtggatgctgtgaacatgcagtggatgcagtgatcctgcagtgattgcagtaaccggcatttccacatcagctcaaaggagtgtccctgcaggggttgcagtgccgctttctgtgtccctgaagttggattcagtgcacatgcagtggatgcagtgtccttcaagatggatgccttatgttgtaatggaggattcagtgatcatgaaggagggttcagtggtcctgcagtcattgcagtgcacatgcagtgccacttcagctggctgcgatgtctctacagtggttacagtgccccgttctctgtccctgaatgtggatacagtgcccatgcagtggactcagagtaccaaaagttggttgacgtatgttgtgacagagaatgcagtggacaagatttggatgcagtgagccggcagtggttgcagtgcacgctgctgtgtccctgaatgtggatgctctgaacatgcagtggatgcagtgatcctgcagttattgcagtgcgcctgcatttccacatcagctgtaagcagtgtcccagcaggggttccagtgaagccttctatgtccctgaaggtgaatgcagtgtccatgcagtggatgcagtgtacctaaatgtttatgcagtatgttgtgatggaggatgcagtgcccatggagggggatgcagtgtccttgcagtggttgcagtgcccccggcattgtccgggaatgtggatgcagtgctcaggcagtggatgcagtgtcccacaaggtggatgcagtatgttatgtttgataatgcagttctcatgaaggtggatgcagtgtccctgcagtgcttgcagtgccccccacattgtccaggaatgtggatgctgtagtaatgcagtggatgcagtgtcccaaaggtggatgcagtatgttgtgatggatgatgcagggcccatgatggtggatgcagtgatgctgcagtggttgcagtgcccctacagtttgctgaatgtggatgcagtgcagatggagcagtcgcagtcccaaaagttggatgtcttatgttgtgatggaagatgtagtgcccacgaaggtggatgcagtgagcctgtgctgaatgcagtgcaccagcagtgctaattcagctgtatgcaatgtctctgcagtggttgcaatgtgcactgcatggtccgagaacgtggatgcagtgcccatgcattggatgcagtgtcccacaaggtgcatgcagtatgttgtgacgaaggatgcagtgcccatgaaggtggatgccgtgatccagcagtggttgctgtgcacactgctgtgtccctgaatgtggatgctgtgaacatggagtgtatgcagtgatcctgcagtcattgcagggcatctgcatttccacatcagctggaagcagtgtccctgcagggattgcaatgccgccttctgtgtccctgaaggtgaatgcagtgcccatgcagtataagcctaaaggtttatgcagtattttgtgacagagaatgcagtacccatgaggtggatgcagtgtagccgcagtggctgctgtgcccctggcatggtactgtaatgtggaggcaggggtcatgcagtggatgcagtgtctcacaaggcggatgcagtatgttttgttggagcatgcagtgcccatgaaggttgatgcggtgcacctgcagagtttgcagtgcccctacattttccctgaatgtggattccgtcaccatgcaattcatgtagtgtcccaaaagttggatgcattatgttgtgagggaggatgaagtgcccacgaaggtggatgcagtgccatttcagctgcatgtggtgttgctgcagtggttgcaccaccagctgctgtgtccctgaacgtcgatgcagtgcccaggcagtggatgcagtgtcccacaatgtgcatgctgtatgttgtgaaggagggtgaagtgcccaagaaggtggatgcagtgagcctgcagtgattgcagcgcacatacagtgccacttcagctggatgcagtgttgctgcagtggttgcagtccccactgaattgtccggaaatgtggatgcattagttatgcagtggatgcagtgtcccacaagttggatgcagtatgttgtgatggaggacgcagtgcccatgaaggtgcatgcagtgatcctgcggtgtttgcactgccccctgcagtttacctgaatgtggatgcagtgctcatgcagtggttgcagtgtccctcaaggtggatgccttatgttgtgatgaaggattcagtgatcatgaaggaggatgcagtgatgcttcattcattgcagtggacctgcagtgccacttcacctggctgcagtgtacctgcagtggttgcagtgccccgatctgtgtccctgagtgtggatgaagtgcccatgccgtggatgcagagtaccaaacgttggttaacgtatgttgtgacagaggatgcagtgcccacgagttgcatacagtgagccagctgtgattgcagtacgccttcagtgccacttcagctgggtgcagtgtccctgcaattgtttcaatgccccctacattgtcctggaatgcggatgcagtgcttcatgcagtgcatgaagcgtcccaaaacgtggaggcattgtggtgtgt

SEQ ID NO: 65 - DNA, 4319 bp, Equus caballus
cttatgatgtgatggaggattcagtgatcatgaaggaggatgcagtgatcctacagtcattgcagtgcacctgtagtgccagtgcagctgggtgcagtgtcccttttgtggttctagtgccccgttctgtataccagagtgtggatgcagtgcacatgcagtggatgcagagtaccaaaagttggttgccgtatgttgtgacagaggatgcagtgcccacaagatggatgcagtgatcctacagtggttgcagtgccccctgcagtttacctgaatgtggatgcagtgctcatgcagtggatgcagtgtcccacaatgtggaggaggtaggttctgacgcacaatgcagtgcccatgaaggtgcattcactgaacctgcagtaattgcagtgcgcctgcagtgccacttcagctggatgcagtgttgctgcactggttgcagagccaactgcagtgtccctgaatgtggatgcagtgcccatgcaggagttgcagtgtcccacaaggtggatgtcgtatgttgtgatcgaagatgcagtgcccacgaacgtggatgctgtgagactgtgctgaatgcagtgtgcccacattgtgacttcagctgtatgcagtgtccctggagtggttgcagtgcccgcaacattgtccaggaatgtggatgcattagtcgtgcagtggatgcagtgttccagaatgtgcatgcagtatgttgtgacggatgatgcagtgcccatgaaggttgatgtagtgatcctgcaatggatgcattgccccccagcagttaacctgaatgtggatgcagtgctcatgcagtggatgcaatgtccctcaagttggatgccttatgatgtgttggaggattcagtgatcatgaaggaggatgcagtgatcttgcagtcattgcagtgaacttgcagtgccacttcagctggctgcactgtccctgcagtggtttcagtgccccgtcctgtgtccctgaatgtggatgcagtgttcatgcagtggatgcactgtcccacaatgtctatgcattgtggtgtgttgtagtatgcagggcccatgaaggtgaatgcagtgatactgcagtgatggcagtgcgcctgcagtgccacttcagctggatgcagtgtccctgcagtgcttgaagttccttctgcattgtcctggaatgtgcatgctgtggccaggcagtggatgcagtgtcccacaaggtggatgcagtatgttatgacggatgatgcagttctcatgaaggcggatgcagtgtccctgcagtggttgcattgcccctggcattgtgctggaatgtggatgcaggggtcatgcagtgcatgcagtgtctcacaaggcggatgcagtatgttaggttggaggatgcagtgcccatgaaggtggatgaggcaaacctgcagcggttgtagtgacccctgcactttacatgaatgtggatgcagtggtcatgcagtggatgctgtgtccctcaaggtggatgccttattttgtgatggaggattcagtgatcatcaaaaaggatgcagtgatcctgcagtcattgctgtgcacctgcactgccacttcagctggctgcagtctccctgcagtttttgcagtgccccgttctgtgcccctgactgtggatgcagtgcccatgcagtggatgcagagtaccaaatgttggttgctgtattttgtgatggaggatgcagtgccctggagttggatgcagtgagctggcagtgattgcagtgcgccttcagtgcaacttcagctggatgcagtgtcctgcagtggttgcaatgccccctgcattgtcctggaatgtggatgcagtggtcatgcagtggatgcagtgtcccacaatgtggaagtattgtggtgtattgtagtatgcagtgccaatgaaggtgaatgcagtgatcctgcagtgatgggagtgcgcctgcagtgccacttcagctggatgcagtgtccctgcagtggttgcagtgcaacccgctctgtccctgaacgtggatgcagtgacattgcaggaaatgcagtgaaatttcagtgattgcagtgtgcctgcagtgacacttcagctggatgctgtgtagctgcagtggttgcagagccccctgccatatccctgaatgtggatgctgtgcccatgcattgtctgcagtgtgactcaaggtggatgcagtatgttgtgaagtaggattcagtgcccattaaggacgatgcctgtaatcctgcaatcattgcagtgcacctgcagttccacttcatctgcatgcagtgtccctgcattgattgaagtgcaccaagctctgaggctgaatgtggatgcagtgccaatgcagtggatgcagtgtcccacaatgtgcatgcagtatgttatgagggagcatgcagtgcccatgagtgtggatgcagtggtccggcagtggttgcagtgccccctgctgtgtccctgaatgtgcatgctctgaacatgcagtggatgcagtgatcctgcagtgattgcagagcacctgcatttccacatcagctggaagcagtgtcactgcaggggttgcagtgcagctgtgtcactgaaggagaatgcagtgcccatgcagtggatgcagcatcccacaatgtgcatgcagtatgttgtgatgaaggatgcagggctcatgaaggtggatgtactgatcctgcagtggttgcagagcccctgcagtttacctgaatgtggatgcagtgctcatgcagtggatgcagtttccctcagggtggatgccttatgttttgatggaggattcagtgatcatgaagtttgatgcagtgatcctgcagtcattgcagtgcaacggcagtgccacttcagtttgctgctgtgttcctgcagtgatggcagtgcctcgtctgtgtccctgagtttggatgcagtacccaggcagtggatgcagagtatcaaatgttggttgccgtatgttgtggcagagaatgcagtgcccacgagttggatgcagagagccgtcagtgattgcagtacgccttaagtgtaacttcagctggatgcagtgtccctgcagtggtggcaatgccccctgcattgtcctggaatgtgaatgcagtgctctgcagtcccacaattttcaggcattgtggtgtgttgtagtatgcagtgctgatgaaggtgaattcagtgatcctgcagtgatggcagtgcgcctgcagtgacacttcagctgtatgcagtctacctgcagtgcttgcagtgcctcctgcattgtcctggaatgtggatgcagtgctcatgcagtggaagcagtgtcccacaaggtggaggcattgtggtgtgttgtagtatgcagtgccgatgaaggtagatgcagtgatctggcagtcgttgcagttcgccctcctctgtccctgaatgtgcatgctatgaacatgcagtggacgtagttatgctgcagtgattgaggtgtgcctgtatttccacatcagctggaagcagtgttgctgccggagttgcagtgccccctaaattgacctggaatgtggatgccgtccccgggcagaggatgctgactcccaaaaggtggatgcagtatgttgtgatggaggatgcagggccccttaaggtggatgctgtgatgctgcagtggttgcagtgccccctacacttccctgaatgtggatgcagtgcccatgcagtagttgcagtgtcccacaaggtggatgtcttatgttgtgatggaagatgcactgagcacggaggtggatgcagcgagcctgtgctgaatgcagtgtgcctgcagtgcgacttcagctgtatgctgtgtccctgcagtggttgcagtgctcactgcattgtctgagaccgtggatgcagtgcccaggcagtggatgcagtgtcccgcaaggtgcatgcagtatgttgtgacggatgatgcagtgaccatgaacgtggatgccgtgatccagcagtgcttcaagtgcaccctgctgtgtccctgaatgtagatgctgtgaacatgcagtggatgcagtgatcctgccgtgattgcagtgcacctgcatttccacatctgctggaagcagtgtccctgcaggggttgcagtgccgcctttgtgtcagtgaaggtgaatgcagtgcccatgcagtggatgcagtgtacgtaaaggtttatgcagaatgatgggacagaggatgcagtgcacatgaatgtggatgcagggttccatgcagtggcttccagtgccctggcattgtccttgcaatgtggatgcagtgctcatgcagttgatgcagtgtctcagaaggtgatgcattatgaatttct

SEQ ID NO: 66 - DNA, 8842 bp, Equus caballus
atgcagtccctatgcattggatgcggtgtcccacaatgtgctatgcagtatgttgtgatggaggatgcagtgcccatgaatgtggatgcagtgatccagcagtggttgcaatgtcccctgcagtttccctgaatgtggatgcagtgtcccacaatgtgcatgcagtaagatatgacggagtgtgcagtgcccacgaaggtggatgcagtgattctgaagtgatggcagtgtgcctgtggtgccacttcagcttgatgcagtgttgctgcagtggttgcagtgccccctgcattgtgcgggaatgttgatgcaatgcccagacattggatgcagtgtcccacaaggtgcaggcagtatgttgtgacagaggatgcagtgcccatgagggtggatgcagtgatctggcagtgtttgcagtgcaccctgctttgtccctgaatgtggatgctgtgaacatgcagtgtatgcagtgatcctgcagtgattgcagtgtgactgccattccacatcagctggaatcagtgtccctgcagtggttgcagtgtggccttctgtgtccctgaaggcgaatgcagtgcccatgcagtggatgcagtgtacctaaaggtttatgcagtatgttgtgtcggaggatgcagtgcccatgaagggggatgcagtgtccctccagtggtagcagtgccccaggcactttcatgaaatgttgatgcattgcctatgcagtggatgcagtgaatcttcagtgattgcagtgtgcctgcagtgcctcttcagcaggatgcagtgtagctgcagtggttgcagagacccctgacacattcctgaatttggatgctgtgcccatgcagtgtctgcagtgtgaatcaaggtggatgcagtatgttgcaaagcaggattcagtgcccctgaaggatgatgcagtgatcctgcagtccttgcagtgcacctgcagtgccacttcatgtggatgcagtgtccctgcagtggttgcagtgcaccctgctgtctcccagaatgtagatgctgtgaacatgcagtggaggcagtgatcctgcagtgattgcagtgcgcctgcatttcctaatcagctggcagcagtgttgctgcagtggttgcagtgccgccatctgagtccctgtaagtgcatgcagtgtccatgcagtggaggcagtgtacctaaaggtttatgaagtatgttgtgacgcaggatgcagtgcgcatgaatgcagatgcagtgtccctgcagtgattgtagggctcccagcattgtgctggaatgaggatgcaggggtcatggagtggatgcagtgtctcacaagttggatgcagtatgctttgtcggaggatgctgtgcccatgaaggtggatgcagtgaacctgcagggcttgcagtgccccctacagtttccctgaatgtggatgcagtgcccatgcagtgcatgcagtgccccacaacgtggatgcagtatgttgtgactgagatgcagtgcccacaatgtaggatgcagtgagcttgcagtgattgcagtgcacctgcagtgctacttcagctggatgcagtgttgttgaagtggttgcagagccaactgcagtgtccctgaacgtggatgcagtccccatgcagtggatgcagtgtcccacaatgtgcaagaagtatgttgtgacataggatgaatagcccatgaaggtggatgcagtgaaccagcactggttgcagtgccccctgcagcttacctgaatgtggatgcagtactcatgcagtggatgcagtgtccctcaaggtggatgccttatgttgtgatggatgattcactgatcatgaaggaggatgcagtgatcccgcagtcattgcagtgaacttgcagtgcgacttcttctggctgcagtgtccctgcagtgcttgctgtgccccccacattgtcctggaatgtggatgcagtagtcatgcagtggatgcagtgtcccacaaggtggatgcagtttgttgtgatggaggatgcagggcccatgaaggtggatacagtgatgctgcagtggttgcagtgcccccaacagttccctgaatgtggatgcagtgcccatgcagtacttgcagtgtcccacaaggtggatgtcgtatgttgtgacagaggatgcagtgcccacgagttggacgcagtgagccggcagtgatggcagtgcacctgtagtgccacttcagctggatgcagtgtccctgcagtggttgggatgccccctgcatttacctggaatgtggatgcagtgctcatgcattgtatgcagtgtcccccaaggtggatgcaatatgttgtgatggaggatgcagggcccatgaaggtggatgcagtgatctgcctgtcatggcagtgcgccagcagtgccacttcagctggatgcagtgttgctgcattggttgcacagccaactgcaatgtccctgaatgtggatgcagtgcccatgcagtggatgaagtgttccacaatgagcatgctgtatgatgtgatggaggatgcagtgctaatgaagttgaatgcagtgagcctgcagtcattgcagtacacctgcagtgccacttcagctggctgctgtgtccctacagtggttgcagtgccccgttctttgtccctgactgtggatgcagtgcccatgcagtggatgcagagtaccaaatgttggttgccatatgttgtgacagaggatgcagtgcctgcgatttggatgcagtgagctggcagtgattgcagtatgccttcagtgccacttcagctggatgcagttacctgcattgcttgcagtgcccctggcattgtcccacaatgctgatgcaggggtcatgcagtgggttcactgtctcacaaggcaaatgcagtacgttttgtcggaggatgctgtgcccatgaaggtggatgcagtgaaccagcagtgcttgcaatgtcccacaaggtggatgcagtatgttatgatggatgatgcagttctcatgaaggtggatgcagtgtccctgcagggcttgcagtgaccccgcattgtccaggaatgtggacgcagtagtcatgcagtggataagtgtcccacaagatggatgcagtatgttgtgatggagtattcagggcccatgaaggtggatgcagtgatgctgcggtggttgcagtgccccctacagttccctgaatgtggatgcagttctgatgcattggatctagtgactcacatggcagatgcagtatgttttgtgggaggatgcagttcccatgaaggtgggtgtggtgaacttgcagtggttgcagtgccacctgcactttaccagaatttggatgcagtttcagtgccgccttctgtgtccctgaaggtgaatgcattgcccaaccagtgaatgcagtgtacctaaaggtttatgcagtatgttgtgacgaaggatgcagtccccatgaaggttgatgcagtgtccctgcagtggctgcagtgcccctggcattgtcccataatgtggatgcaggggtcatgcagtggatgcagtgtctcacaaggcagatgcagtatgttttgtcagaggatgcagtgccacttcagccggatgcagtgtagctgcagttgttgcagagccaaatgcagtgtccctgaacgtggatgtagtgcccatgtggtgcatgcagtgtcccacaaggtggatgcagtatgttgtgagggagaatgcattgcccacgaagttggatgcagtgagctggcagtgattgcagtgcacctgcagtgccactcagctgcatgcagtgtccgtgcagtggttgcagtgcctactctctgttcctgaatgtggatgcagttcccctgcagaggatgcagagtacaaaatgttggtgtccatatgttgtgacaaagcacgcagtccccatgaaggtggatgcagtatccctgccagtgttgtagttccctcggcattggttctggaatgtggatgcaggggtcatgcaatggatgctgtgtctcacaaggtggctgcagtcagcctgtgctgaatgcagtgcacctgcagtgtgacctcagctgtaggcagtgtccctgcagtggttgcagtgcacaatgcattgtctgaatacgtggatgcagtgcccaggcattgggtgcaggttcccacaagatgcatgcagtatgctttgatggaggatgcagtgcacatgagggtggatgccgtgatccagcagtagttggaatatgcctgcatttccacatcagctggaagctgtgtccctgcaggggttgcagtgcccctggcattgtcctgaaatgttgatgcagtgcctaagcagtggtgcagtgaatcctcagtgattgcagtacgcctgcagtgtcacttcagctggatgcagtgtagctgcagtggttcagacccccagccatgtccctgaatttggatgcggtgcccatgcagtggatgcagtgtcccacaatgtggaggcattgatgtgtgttgtagtatgcagtgctgatgatggtgaatgcagtgatcctgcagtgatggcagtgcacctagagtgccactttagctggatgcagtgtatctgcagtggttcagacccacagccatgtccctgaatgtggatgtggttcccatgcagaggatgctgagtaccaaaagttggttgccatatgttgtgacagaggatgcagtgcccacgagttggtcacagtgatctggcagtggttgcagtgcagcctgctgtgtccctgaatgtggatgctatcaacatgcagtggatgcagtgatcctgcagtgattggtgtacgcctgcgtttccacatcagctggaagcagtgtccctacagtggtttcagtgccgccttctgtgtccctgaatgtgaatgcattgtccatgcagtggatgaagtgtacccaaaggtttatgcagtaagttgtgacgaaggatgcagtgtccatgagggtggatgcagtgtccctgcagtggtggtagttctcctggcattgttctgcaatgtggatgcaggggtcatgcagtggatgctgtgtcttacaaggcggatgcagtatgatttctcggaggatgcagtgcccatgaaggtggatgtggtgaacctgcagtggttgcagtgccctctagagtttccctgaatgtggatgcagtgcccatgcagtacatgcagtgtcccacaaggtggatgcagtatgttgtgatggaggatgcagtgccccacaaggtggatgcagtatgttgtgacggaggatgcagtggccacgaaggtggatgcagtgacactgcagtgattgcagtgacctgccgtgccacttcagcttgatgcagttttgctgcagtgattggagagccaactccagtgtccctgaaggtggatgcagtccccatgcagtggttgcagtgtcccacaatgtgcatggtgtatgttgtgatggagcatgaagcacccatgaaggtggatgtggtgatgctgcagtggttgcaatgccccctgcagtttacctgaatgtggatgcagtgttcatgcagcagatgcagtgtcacccaaggtggatgccttatgttgtgttggaggattcagtgatcataaaggtggatgcagtgtccccacagtggttgcagtgcccccagcattgtcctgaaatgttgatgcagtgcctatgcagtgggtgcagtgaatcttcagtgattgcagtgtgcctccagtgccctttcagctggatgcagtgtagctgcagtggttgtagagcccctgccctgtccctgaatgtggatgctgtgcccatgcagtgtctgcagtgtgactcaaggtggatgcagtgtgttgtgtagcaggattcagtgcccatgaagaacgatgcagtgatcctgatgtcactgcagtgcacctgaagtgccactttatcttgatgcagtgatcctgaagtgcttgcattgcgcctgcatttcctaataagctggaagcattgttgctgcagtgattgcagtgcagccttctgtttccctgaaggtgaatgcagtgcccatacagtggatgcagtgtaactaaagttttatgcagtacgttgtgacggaggatgcactgcgcatgaaggcagatgcagtgtccctgcagtggttgcatggcccctggcattgtgctggaatttggatgcaggtgtcatgcagttgatgcagtgtctcacaaggcagatgcagtatgctttgccggaggatgcagtgtccatgaaggtggatgtggtgaacctgcagtggctgcagtgcccatacagtttccctgaatgtggatgcagtgcccatgcagtgcacgcagtgtcccacaatgtggatgcagtatgttgggacagaggatgcagtgcccaggaagatggatgcagtgagcccgcagtcattgcagtgcgcctgcagtgccacttcaactggctgcagtgtccctgcagtgcttgcagtgccccgttctttgtccctgagtgtggatgcagtgcccatgcagtggatgcagagtacaaaacgttggttgcggtatgtcgtaagagatgatgcagtgcccacgagttagatgcagtgagctggcagtgattgcagtacgccttctttgcaacatcagctggatgcagtgacctgcactggttgcagtgcccctggcattgtctcgtaatgtggatgcaggtgtcatggagtggatgcagtgcctcacaaggcagatgcagtatgttttgtcggagagtggagtgcccatgaaggtggattcagtgagcctgcagtaattgcaatgctcctgcagtgtcacttcagctggatgcagtgttgcagcagtggttgcagagccaactgcagtgtccctgaatgtggatccagtgcccatgcagtggatgcagtgtctcacaaggaggatgcagtatgttttgtcagaagatgcagttcccatgaagttggatgcagtgaacctgcagtggttgccttgccacctgaactttaccagaatttgggtgcagtgctcatgcagtggatgctgtgtcccacgaagtggatgttgtatgttgtgatggacgatgcagtgccatgaaggtggatgcggtgatgcggcagtgtttgcactgcccctgcagtttacctgaatgtggatgcagtggtcatgcagtggatgcagtgtccctcaacgtggatgccttatgttgtgatggaggattcagtgattatgaaggtggatgcagtgatcctgcagtcattgcagtgcatcaccagtgccaattcacctggcttcagtgttcctgcagtggttgctatgcacccggcattgtcctgaaatgttgatgcagtgcctatgcagtggatgcagtgaatcttcagtgattgcagtgcgcctgcagtgacacttaagctggatgcagtgttgctgcagtggttgcagagccaggtgctgtggcactgaacgtggatgcagaggccaggcagtggatgcagtgtcccacaaggtggatgcagtatgttatgtcggatgatgcagttcttaagaaggtggataccatgtccctgcagtgcttgcactgccccccgcaatgtcaaggaatgtggatgcagtagtgatgcagtggatgcagtatcccacaaggtgtatgctgtatgttgtgatggaggatgcagtgcccatgaggctggacgcagtgatccggcagtgattgcagtgcaccctgctgtgtccccgaatgcgcatgctctgaacatgcattggatgcagtgatcctgcagtgattgcagtgtgcctacattacctcatcagctgtaagaagtgtcccagcagtggttgcagtgccccctgcattgtccgggaatgtggatgcagtggccatgcaatgcatgcagtgtaccacaaggtggatggagtatgttattacggatgatgcagttctcatgaaggtggatgcagggtccctgcagtgcttgcagtgccccccggattgtcccggaatgtggatgcagtagtcatgaagtggatgcagtgtcccacaaggtggatgcagtctgttgtgatagaggatgcagggaccatcaaggtggatgcagtgatgctgccatggttgcagttcaccctacagtctccctgaatgtggatgcagtgcccatgcagtgcatgcattgtccaacaaggtgcatgcagtatgtcgtgatggaggatgccgggcccatgttggtggatgcagtggccctgcagtgggtgcagtgcccaatgcattgtccgtgatcgtggatgcagtgccccagacttggatgcagtgtcccacaaggtgcatgcagtatgttgtgatggaggatgcagtgcccatgacggtggatgcaatgatctggcagtggttgcagttcaccctgctgtgtctctgaatgttcatgctctgaacatgcagtggatgcagtgatcctgcagttattgcagtgcacctgcatttccacatcagctggaagctgtgtccctgcaggggttgcagtgttgccttctgtgttgctgaatgtgaatgcagtgcccatgcagtggatgcagtgtacctaaaggtgtatgcagtatgttgtgatggaggatgcagtgtccatgaaaagaggatgaagtgtctctacagtggttaaaagttgcatccagcaatgtccctggaatgttgtggaggcttatgccatgtatgcagtgaatcttcattgattgcaatggagccaaactttgccacactccaactgtatgccgtggagctgaactccgatacataaacgcccaaccgaggacccctattgtgaatagtgtagcgcttctaggagccccctgcgcaaccccgcgatcgcattcagaaatgtattgaggggcgacttca

SEQ ID NO: 67 - DNA, 848 bp, Equus caballus
ccatgaaggtggattcagtgatgctgcagtggttgcagtgccccctacagttccctgaatgtggatgcagtgcccatgcagtagttgcagtgtcccacaaggtggatgtcgtatgttgtgatggaagatgcagtgcccacgaaggtggatgcagtgagcctgtgctgaatgcagtgtgcctgcagagcgacttcagctgtatgcagtgtccctgcagtggttgcaatgcctgctgcattgtccgagaacatggatgcagtgcccaggcattggatgcagtgccccacaaggtgcatgcagtatgttgtgatggagaatgcagtgcccatgagggtggatgcagtgatccagcagtggttgcagtttccctgctgtgttcctgattgaggatgctgtcaaaatgcagtggatgcagtgatcctgcgttgcttgcagtgcccctgcatttccacatcagctggaagcagtgtccctgcaggggttgattgctcacttctgtgtccctgaagttgtattcagtgcccatggagtgggtgcagtgtacctaaatgtttatgcagaattatgtgacggagtatgcagtgcccatgaaaggtggatgcagtgatccttcagtggttgaagtgcccccagcagggtccctgaatgagaatgccgtgcccttatagtggattcagtgccccacaatgtggatggagtatgttttggagtcatgagtcatggcccatgaagatgaacggcgggttcacgaacctccgtctacattttagatctgtgtcactgattctggatgcatgtgtccatgcgggggaacgcagagtcctcacaaggcatgatgaggtatgttg

SEQ ID NO: 68 - DNA, 6859 bp, Equus caballus
accggctgatgcattgcccatgaaggtgcatgcaagtgttcctgccctggttgtcataccccctttctgtgtccctgattgtggaagcagtgcccatgcagtggatgcattttcccacaaggcagatggcctatgtttgacaggggatgcagtgccccatgaatgtcgatgaagtgatccctgcagtggttgcagtgctcatgcagtgccacttcagctggatgcagtgtccctgccatcgctccagagcaaactaccctgtccctgaatttggatgcagtgcccatgcagtggatgcagtgccccacaatgtggaggcattgtggtgtgttgtagtatgcagtgccgatgaaggtgaatgcagtgatcctgcagtgatggcagtgcgcctgcagtgccacttcagctggatgcagagttgctgcagtggttgcagtgccccctgcattgtccgggaatgtggatgcagtgcccaggcagtgcatgcaatgtccaaaaagatggatgcaatatgttgtgatggagtatgcagtgcccacaatgtggatgcagtgtagctgcagtacttgcagagccccctgccatgtccttgaaggtggatgcagtgcccatgcagtgaatgcagtgtacctaaatttttatgcagtatgttgtgacggagaatgcagtggccatgaaggtggatgcagtgatagtgctgtggttgcagtgccctagcagtttccctgaatgtggatgcagtgcacatgcagtggatgcagtgtcccacaaggtggatgccttatgttgtgatcgtggattgagtgatcatgaaggaggatgcagtgatcccacagtcattgcagtgcacccacaacgccacttcagctggatgcagtgtacctgcagtggctacagtgccccctgcattgtcactgaatgtggatgcagagccccgacagtggatgcagtgtcccacaatgtgcatacagtatgttgtgacagaggatgcagtgcccatgaaggtagctgcagtgatctggcaggggttgaagtgcaccccgttgtgtacttgcatgtgaatgctgtgataatgcggtggatggagtgatcctgcagtgattgctgtgcgcctgcatttccacatcagcaggaagcagcgtacctgcaggggttgcagtgtcgacttctgtgtccctgaagttgaatgcagtgcccatgcagtggatgcagtgaaacttcacagattgcagtgtgcctgcagtgccacttcagctggatgcagtgtagctgcagtggttgcagagcccctgccatgtacctgaatgtgtatgcagtgcccatgcattgtctgcattgtgatgcaaggtggatgcattatgttgtgaagtaggattcattgcccatgaaggatgatgcagtgatcctgcattcattgtagtgcacctgcagtgactcttcatttggatgcagtgtccctgcagtcgttgcagtgccaccttcagtgtccctgaatgtagacgcagtgcccatgcagggcatgcagtgtcccacaaggtggatgcagtgcccacgaaggtggatgcagtgagcctgcaataattgcagtgcggctgcagtgccacttcagctggatgcagtgttgctgccatggttgcaagccaactgcagtgtccctgatcgtggatgcagtgccaatgcagtggatgcagtatgttgtgacggagtatggagttcccatgaacgtggatgcagtgatcctgcagtgtttgcagttccacgtgcagtttccctgaatttggatgcagcgctcatgcagtggatgcagtaatcctgcagtggttgaagtgccaccctctgtgtccctgaaggtgaatgcagtgcccatgcataggatgcagtgtatctaaaggtttacgctgtatgttttgatggaggatgcagtgctcatgaaggtggatgcagtctccctgcagtggttgcagtgcccctgtcattatcctggaatgtggaagcaatggtcatcgggtggatgcagtgtctcacatggcagatgcagtatgttttattggagtatgcagtgccagtgaaggtggatgcagtgaacctacagtgggtgcagtgccccctgaagtttacctgaatgtggatgcagtgctcatgcagtggatgcagggtcccacaaggtgtatgcagtatgttatgacagatgatgcagtcctcatgaagatggatgtgttttccctgcagtgcttgcagtgcccccagcattgtccgggaatgtggatgccatagtcatgcagtggatgcagtgtcccacaaggtgaatgcagtctgttgtgatggaggatgcagcgcccatgaaggtggatgcagtgatgctgcagtttttgcagtgcccctgacaattccctgaatgtggatgcagtgcccatgcagtcattgcagtgccccacaaggtggatgttgtatttgtgatggaagatgcagtgcccacgaaggtggatgcagtgagcctgtgctgaatgcagtgctcctgcagtgcgactttggctgtatgcactgtccctgcgtggttgcactgcccatcgcattgtctgaggacgtggatgcagtgcccaggtatcagatgcagtgtcccagaaggtgcatgaattatgttgtgatggaggatgcagtgcccatgaaggtggatgcagtgatctggcagtggttgcagtgcaccctgctgtgtccctgtatgtggatgctgtgaacatgcaatgaagcactgatccagcagtgactgcagtgcgcctgcatttccacatcagctggaagcagtgtccctgcagtggttgcaatgccccctgcattgtcctggaatgtggatgcagtgctcatgcagtgcatgcagtgtcccacaatgtggaggcattgtgatgtgttgtagtatgcagtgccgaagaaggtgaatgcagtgatcctgcagtgatggcagtgcacctgctgtggcacttcagctggatgcagtgttcctgcagtggttgctgtgcttcctgcattgtccgcatatgtggatgcagtgcccatgcattggacgcagtgtccgacaaggtggatgcagtatattatgactgatgatgcagatctcatgaaggtggatgcagtgtccctgcagtgctttcagtgacccccagattatccgggaatgtggatgcagtagtcatgaagtggctgccgtgtcccacaaggtggtttctgtatgttgtgatggaggaagcagggcccacgaaggaggatgctgtgatgctgcaaaggttgcagtgccacctacagttccatgaatttggatgcagtgcccatgcagtagaggcagtgtccccccaggtggatatcgtatgttgtgatggagatgcagtgcccacggatgtggatgcagagagactgtgctgaatgcagtgtgcctgcattttgacttcagctgtattcagtgtcccagcagtggtttcagggcccactgcattgtcaggaaatgtggatgcagtagtcatgcagtggatgcagtgtgaccctaggtggatgcagtatgttgtgaagtggaattcagtgcccatgaaagatgatgcagtgatcctgcatggattgcagtgcaactacagtgccacttcatctggaggcagtgtccctgcagtggttactgtgcccactgcttggacctgaatatggatgaagtgcccattcagtgaatacagtttcccacaatgtggatgcagtatgttgtgacggagggtgaagtgtccaggaaggttgatgcagtgagactgtagtgattgcatgcacatgcagtgccacttcagttggatgcagtattgctgcagtggttgcagagccaactgccatgtccctgaacgtgaatgcagtgcccatgcagtggatggagggtcccacaatgtgcaagcaatatgttgtgatggaggatgtgttgcccatgaatgtggatgcagtgatcctgcagtggtttcagtgcccactgcattgtcctggaatgtggatgcagtggtcatgcagtggatgcagtgtctctcaatgtgcatgcattatgttgtgatggaggatgcagtgtgcatgaaggtcgatgcagtgatcctgcagtgattgcagtgccccctgcagtttccctgaatgtggatgctgtgctcctgcagtggatgcagtgccctacaaggtggatgcattctgttgtgatggaggattgagttttcatgaaggaggatgcagtgatgttgcagtcattgcagtgcacctgcaattccacatcagctggaagcagtgttgcttcagtggttgcagagctgccttctgtgtccctgaaggtgaatgcagtgccaatgcagtggatgcagtgtacccaaaggatagtgcagtatgttgttatagaggatgcagtgcccacgaaggtggatgcagtgagcctgcactgattgcagtgcccatgcagtgccacttcagctggttgcagtgttccagcagtagtgcagagccaacaccagtgtacttgaacgtggtagcagtgcccatgcagtggatgcagtgtcccaaaatgtgcatgcagtatgtggtgacagaggatgcaggcccacgaagattgatgcagtgtccctgcaatggttgtagtgcccctggcattgccctggaatgtggatgcagttgtcctgcagaggatgcagtgtctcacaaggcggatgcagtatcttttgccaaaggatgcagtgcccatgaaggtgaatgtggtgaacctgcagtggttgcagtgccctgtacagttttcctgattgtagatgccttgcccatgcagtgcatgcattgtcccacaaggtgaatgcagtatgttgtgaaggaggctgcagtgcccacgaatgtggatgcagtgaggatgcagtgattgcagtgcacctacagtgccacttcagctggatgcagtgttgcagcagtggttgcagagccatctgcagtgtccctggacctggatgcaatccccatgcagtggatgcagcgtaacacaaggtgcatgcaatatgttttgaaggaggatgcagtgctcatgaaggtggatgcagtgatcctgcagtggttgcagtggcccctgcagtttacctgaatttggatgcagttctcatgcattggatgcagtgtcccaaaatgtggatgccttatgatatgacggagcgttcatagatcatgaaggagcatgcagtgaatctgcagtcattgcagtgaacctgcagtgccacttcagctggctgcagtgtccctgcagtggttgcaatgtcggttctgtgtccctgaatgtggatgcagtgcccatgcaatggatgcagagtcccaaaatttggctgctgtatgttgtgatagaggatgcagtgcccacaagttggatgcagtgagtcggcagtgattgcagtacgccttcagtgacactcaagctggatgcagtgtccctgcagtcattgcaatgcccgcagcattgtcctggaatgtggatgcagtgctcatgcagtggatgtagggtcccacaatgtggaggcatttggtgtgtggtgacatgcagtgccaatgaaggtgaatgcagtgatcctgcagtgatggcagtgcacctgcagtgccacttctgtgtgatgaagtgtcgctgcagtggtggcagagcccagtgccatgtccctgaatttggatgcagtgcccatgcggtgtctgcagtttgacccaaggtggatgtagtatgttgtgaagtaggattcagtgcccatgatggatgatgcagtgatcgtgcagcaattgcagtgcacgtgctgtgccaattcatctagatgcagtgtccctgctgtggttacagtgccccctgcattgtccctgaatgtggatgcagtgcccattaagtggatgcagtgtcccggaaggtgcatacattattttgtgatggaggatgcagtgctcatgaaggtggatgcagtgatcctgcagtggccctgcatggtccctcaatgagaatgccgtgcccttgcagtggattcagtgagccacaaggtggatgcagtatgttatgatggatgacgcattgcccatgaaggtggatgtggtgattctgaagttgttgcagtgtccccttcaggatccctgaaagtggatgcagtgcccaagcagtggatgcagtgtcacacaagttggatgcagtatgttgtcatgaatgatgcagtgcccacgactgtgaatgcagttatagagcagtgattgcagtgcacctgcagtgccacttccactgtataaagtgtccctctagtggtggcagtgtttcctgcattttctgggaatgcagtggcagtgcccaggcagtggatgcaatgtcacacaagttggatgcagtaagttgtgacagaagatgtagtgcccatgaaggtggatgcagtgatccggcagtggtttccgtgcacatggtagtgtccctgaatgtggatgcagtgaacatgaagtagatgcagtgaacattcagtggttgcggtgcacctgaggtgccacttcagctgaaggcagtgttgctgtagtggttgcagagcccaccacaatgtctctgaatatggatgcagggcccatgcagcttctgcagtgtgacccaaggtggatgcagtatgttctgaagttatatgcagtacccatgaaggaggatgcagtgatcctgcattcattgcagtgcacctgcagtgtcatttcatctgggatgcagtgctcctgaatgtggattgagtgctcatgcagtgatgatgtatgttgtgatggaggatgcaatgcccatgaaagcagattccgtgatccctgcagtgatttgctgtgcagctgcaggggcact

SEQ ID NO: 69 - DNA, 1223 bp, Equus caballus
aggatgcagtgctcatgaaagtggatgcagtgatcctgcagtggtttccatgcacactgtagtgtccctgaatgtggatgcagtggacatgaagtggatgtagtgaacattcagtgattgcagtgcagctgcagtgccacttcagctgcatacagtgtccctgcattggttgcagtgctccctacattgtccgggattgtggattcagggcccatgaagcctctgcagtgtgacctgtggtggatgcagtatgttgtgatggaagatacagtgcccacgactgtgaatgcagggtgactccagtgattgtagtgcacctgccctgccacttcaagtgtatacactgttcctgcagtgattgcagtgctgccagcattatccgggaatgcggatgcagtgcccaggcagtggatgcagtgtcacacaatttggatgcagtatgttgtgacagaggatgcagtgcccatgaaggtggatgcagtgatactgcagtgctttccgtgcacactgtagtgttcctgaatgtggatgcagtgaacatgaagtggatgcagtgaacattcagtgattgcagtgcagctgcagtgacacttcagctgcatagtgtccctgcagtggttgcagtgctgcctgtattgtccgagaatgtggattcagggcccaggcagcctctgcagtgtgacccaaggtagatgcagtttgttatgatggatgatgcattgaccctgaaggagaatgcagtgaacatgcattcattgcagtgcacctgcagtgtcaattcatgtggatgcagtgtccttgaatgtggatccagtgctcatgcagtgatgatgtatgttgtcacggaggatgcagagcccatgaaggcagatgcagtgatactgcagtgattgcagtgcgcctgaagtgccacttcagctggatacagagtccctgcaggggttgtagtgcctgttgcagagtccctggacgtggctgcagtgcccatgcaatggctgcagtgtcattgaaggtagatgcagtatgttgtgacggaggatgcagtgcccatgaaggtggatgcagtgatcctgcagtggttgaagtgccccctgcagaatccctgaatgagaatgccatgcctttgcagtggattcagtgccccataatgtggacgaagtatgttttgacggatgatgcattgcacatgaaggtgtatgcagtgttcctgcactggttgtcgt

SEQ ID NO: 70 - DNA, 17627 bp, Equus caballus
atgcagtgctgcagtgccacaaaggtggatgcagtgagcctgcattgattgcagtgcacttgcagtgccacttcagctggatggagtgtagctgcagtggttgcagagcccactgtcatgtccctgaatgtggatacagtgcccatgcaatgtctgcagtgtgacccaaggtggatggagtatgttgtgacttaggattcagagcccatgaaggacgatgcagtgatcctacagtccttgcagggcccctgcagtgacactgcatcttgatgcagtttccctgcagttgttgctgtgcccctagattgtcccagaatatggatgcactgcccatgcagtggatgcagtgccctacaaggtgcatgaagtatgttgtgatggaggatgcagtgaccatgagagtggatgcactgattctgcagtggttgcagtgcaccctgctgtgtccctgaatgtgtatgctgtgaacatgcagcggatgcagtgatcctgcagtgactgaagtgtgccttcatttccacatgacctggaggcagtgtccctgcaggcgttgccatgccgctttcagtgtccctgatggtgaatgcagtgctcatgcagtggatgcagtgtacctaaatgtttatgcagtatgttgtgatagaggttgcagtacccatgaaggtggatgcagtgatcctgcagtggtttccgtgcacactgcagtgtccctgaatttgaatgcactgaacattcagtgattgcactgcacctgctgtgcaacttcagctgaatgcagtgttgttgcagtggttgcagagcccactgcagtgtctctgaatgtggatgcagggcacatgcagtctctgcagtttgacccaaggtggatgtagtatgttgtgaagtaggaggcagtaccaatgaaggaggatgcagtgatcctgcattcattgcagtgcacctgcagtgtcaatttatctggatgccgtgtccctgaatgtggattgaatgctcatgcattggtgatgtatgttgtgatggaggatgcaatgcccatgaaggcagatgcagtgatcctgcagtgattgcagtgcacctgcagtgccacttaagctggatcctgcatccctgcagtggttgtagttcctgttgcagtgttcctgaacgaggcttcagtgcccatgcaatggctgcagtgtcactgaaggtagatgcaatatgttgtgttggagaaagcagtttccattaggtggatgcagtgttccttcactggttgtcgtgcccccttctgtgtccctgattttggatgcagtgcccatgcagtggatgcagtatcactgaaggtagattcagtatgttgtaatggaggatgcaatgcccatgaaggtggatgtgatgattctgcagtgattgcagtacacctgcagtgccacttcagcttgctgcagtgtgcctgcaggtgttgcagtgcccccttctgtgtctctgaatatgaatgcagtgcccattcagtggatgcagaataacaaaagatggatgtggcatgttgtgacagaggatgcagtgcccatgaatgtggacgcagtgatcctgcagtggttgcagttcgcatgcagtgccatttcagctggatgcagtgtccctgcagtcgctgcattgcaacctgcactggccctgaatttggatgcagtgctcatgcagtgatgaagaattttgtgatggaggatgcagtgcccatgaatgcagatgaagtgatcctgcagtgattgcagtgcgcctgcagtgccacttcacctggatccagagtccctgcaagggttgcagtgcctgttgcagtgtccctggacgtggctgcagtgcccatgcaatggctgcagtgtcactgagggtagatgcagtatgttgtgacggaggatgcaatggccatgaaggtggatgcagtgatcctgcagtggtcggagtgccccctgcagggtccctgaatgggaatgccgtgcccttgcagtggattcagtgccccacaaggtggatgcagtatgttatgacggctgatgaattgcccatgaaggtgcatgcagtgttcctgcacaggttgtcatgccccattgtgtttccctgattgtggatgcagtgcccatgcagtggatgcagtgtcccacaaggcagatgcagtatgttgtaatggaggatgcattgcccatgaagctgcatgcagtgttaatgcattggttgtcgtgccccattctgtgtccctgattgtggatgcagtgaccatgaatgtcggtgaggtgatcctgcagttgttgcagtgtcccctccaggttccctaaatgtggatgcagtgcccatgcagtgtatgcagtgtcgcacaaggtggatgcagtatgttgtcacggaagatgcagtgcccacgactgtgaatgcagtgagactgcagtgattgcagtgcacctgcagtgccacttcaactgtatactgtgtccctgcagtggttgcagtgctgcctgtgttatctgagaatgcagatgcagtgcccaggcagtggatgcagtgtcacacaagttgtatgcagtatgttgtgacagaggaggcagtgcccatgaaggtggatgcagtgaccctgcaatggttttcgtgcacagtgtagtgttactgaatgtggatgcatgaagtggatgcagtgaacattcagtgattgcagtgcacctgcagtgccacttcagctgaatgcagtgttgctgcagtggttgcagagcccactgcagtgtctctgaatgtggatgcagggcccatgcagcctctgcagtgtgacccaaggtggatgcagtatgttgtgaagtaggatgcagtacccatgaaggaggatgcagtgatcctgcattcactgcagtgaacctgcagggtcaattcatctggatgcagtgtccctgaatgtggactcactgctcatgcagtgatgatgtatgttgtgatggaggatgcagtgcccatgatggcagatgcagtgatcctgcagtgattgcagtgtgcctgcagtgctacttcagctggattcagagtccctgcaggggttgcactgcctgttgcagtgtccctggacgtggctgcagtgcccatgcaatggctgcagtgtcactgaaggtagatgcagtatgttgtgttggaggaagcagtggccatgaaggtggatgcagtgatcctgcagtggttgcagtgccccctgcagggtccctgaatgagtatgccatgcccttgcagtgaggatttttaggctgcttaattttaaatcgatttatgatgaggatttttaggctggttacttttaaaactacagataagaagcaggctccgaggagtggaatttgtttgtcctttgatcagagacagttgcatttgtgaaggaaatctccatgcctccctctctgcgccaggagaaaggggggatggccttatctctggaaactcttaatggggaaggcaagaacttaagttgtttactgtctggcaacttcacgtaactgaccccccaccccaaaatcctcctttgtctttagttgaagataatatttgagtggtgacttctgccatttactcaatccggtttgattcttatctaaaagttgtgggactgcccaatggccagaccctaccggcactggtaccattataactttttttcctttgtcttgtacagagataactcacatacccatgtcttaaatttagccctaaccctcaactcggagcagcagcaggagctctgactgcctgtgggtcctgtccccacaccagctctgcctgcctatgggtcctgtccccatgccagcaggggcagcagaagcggtggcagcagaagctctgactgcccatgggtcctgtcctcatgctattctatactattctctaaatgaaagagcactactgccagatcttgagagtctaagaaatcttcctttcgactccttggctcaccaaccctgcatcatttctggtggcccttacggggacttgcttcattggcttgtgagctccagttctggtaagtgcccttttccttgtgcctttatctttttcgaggatggatctaaattcatttctccattgggaactttcttggatggctgtatgaatccacgtttgctccccatggctactctatggggcaaattgtggcagtcagcttgaagagaatcagtaccttaagcctcagggtgatggagaatgaattaatccattccttcctgactctatctctaatagacaaattttacgtgggtgcgggttggccacttaagtcattaggacggccgccaatctccaagaatcccgtggaatgtttcttttcctaaggctggattgtgatccctccctctggcacctgaccactctttgaaatgcgggaaggtcccaatcgggactccagttcaagaaaagtaccaaactctaacctttggtggagtatgggaaccccttcttgggagaatggctccaggctgtaattgggtagaatgtcccccagactggcagaaaattcctcactgtttttctctatcctttatcctgggaccattcaccaggagcctattcctgccaggcagaatagggaagatgttcaagggatgcccccatcatcccttgctacaggaaccccaatggggggattttaaaggtaatggctccttttctttctccttttctcttggggaccattcaccaggcctatgctgccaggcagaataggcaccaggcacctgttactgccaggcataacagggaaggtatacaagggatgcaatgccgggagacgcccccatcaccccttgctataggaaccccacagtaggaacaacgggtaggacgctgccctaggttcaggggggatttttcaaggtaatggacccatttctttcgtctctcttagagttacaatggccattttggtctctgtttgagctttgcaactgggaaacaaagaaatctttaaagagtaaaaggcttcacccctgggagccccaactttgggtttctgggcctgatcaccccagcaaccctaagtgggggtgccctttcttccttcgggaagaaaggccccgggccatggttcctcataaagctttgtttaattttctcttactattctgtctcatgtgaatttaattcgttctccagctggacgaacccacatttgggaagaggaaatgtcttcctcccctacagttttggcgcagtcggcaggataaaatttcactggctggtaactgcttgctcctggactgctgcggctgagagatcgcggacccctgacgagagccagcaagaggtaagagttcttaccacgtcagtctcccggatctcttcctgcaggctccaatggaagcaagagtggtgaggggttttttttgctcttctaaatttagattagcaggagaaaatgttggtgaggctatcttctcggattcagtgactatacgatttgagtactcactggttgtagatccttttcctcccagagatagacttttccttgtctctgtcattttgtttgtcataagacacaggcatctctataagcctgttgtctgggctttttgtcttgttatatgtcttgagagcttggttttgtgacctttctggtctccgccatcagaggatgcatgtaccggcacgtatcttggcggccagtcacatagactggggctctgggaaagtttgtcttgagagcttggctttttttgtcaggctgtgtaagctcttggggaagtttgtcataagaggtcccaattgatttcataaggggcctttgttgtctcaacctttgttgcttgcctttactttcttaggctatttttgggagtgaattttctagatctcattcagggacgcctctttgtccttggttaagctttggttgagatgctgttaagatcctactcatcaatttggcctgatcacccctgcaaccctaattgggggtgccctctcttgacggttgactcatcaagtattttagtcacctactgagtccgctatgagggtaggagacctgtgattcattctgtgaattgtcgtgctagggtagtgtgtcccagcacaggaactgttgtgtgactcttatcttgataaccctctggaagtggccaagagggcgaggtctgatctcttctttacctttctttgtctgtttcattcatcatctcctctgttgtcaccaagtctaggttaagttcaggctggacctgaccagaacctggccttctgtgaaattgaaaaacttgaaagccttttgccagggatttaactctcaaccttggtgatggaagtgcctccagcctgttccaggcctttttctcctgcttccctacctcaagtgtgctggctcggagacaaagtgcccaggctgagaaggacttgactaaatcttataacaatgtcaacacccacaatcggactctgcacccttctccagtccactgtcagttggacactggctttaccgccacagggaaggcccctgagcatcccagagacccaccctgtggatgcattctaactccatcttggagaaaacttgaggggtttctctgtgcctttgtgatgcagctggacaggtagatcaacctggaatgtaatttgagttacaatccaccttctgggaaatcaagagcaactgtccttagaaaatccttgcaagactggaaatacagctctagaggcagtgtggactccacctagttcctttatcatgaaaaggattatcatctctcctctccaggaactactatctaagcccatcactaattcctaagactgaagcaaaaacaaaaaaaggaaaaaagagaggaggggagaggcaaaatggccataagcgtgcccttgcaaaaaatctagcatcttgagtatcttctccacaaatattggttaaaaatcattagctgtaacaatagctgtgcagtctctgtgtacgtgtgtctgtgtgtacgttatatgtgtgatattttacctccggatggtattgccaaaattaagaactctgtttaattggcttaaagtaagtgcttacgaaaattctaaatgtagtagaaattaatccaatgtctttcaagttaacgtgatgtgaattaacctttggtaaatgaaagcttgtttaagtttgttggtttgattgaaaatagtcttgttgtcagagttgtcggtatttgcatacgatgcaggcatgcagcctgtgtttcctagtcaaataagttaacgttgtctgttaaattcgtcagcaaaataatagctttaaatgatgaccagttttgtctaatgtctcatgacgttttcataggtaatctgaacataattgttggaaacaaacagtttaaatagataaaagtgggtacaataactgttttatggtctgtatacttggaaaaaaaactgcttcgaaattctttttggtaacaatcttgagttttgccaagttaagttaaatgataaaaacctgagtatctgggtcgtttttgaattggctagaacactgaaacattattgctaaacgtacctaagttatttacctttggcttcttattgtaaagaggctaaaagcatttgggtgtattaaaaagtgtgccttgtgttttattgcgaagcggcgtgtttctagaaattagaaaaagtgtttagaatgttggtatgaaaagacaattcataattgctttccttttagtgtttactagggtctgttaagggttaaaagttctaattaacctatataattaaagctactggaaattaatgaggaaaacagctctgtatacaagaaagttaaaatgtgtgttttcagtaaagagggtataaagaatggaagtatttttgtttgatgggttaagaaagataaatttgtcctaatgtactagaaaggaaaaaagaaagactttgggacaaattctgaaggcaaaaagaaagttgtagaaggtttgtgaaggagaaagtctgaaaggagtcttttgcctggtcaagttggctaagattcaagtaaatccaattaagtgaatgagatttaatgttagtaataagctggtgcagaaattaaaatttggttttctctcaaaggataattttcttgaacttttggcctgctctaactctacctaaaagacaaatctgttttgttaaaataatgactgaagtcactcctaagatttctgattgtttctgttgtcagtttaaatagataggtgagcattgtttcacagtgagcgctgtttgaacaagtgttctaaaaacttttcatatttttgacaagcttctccctcaaatattcaaatcctgaatgaaggaaaatactaaactaattaggcttatttggtccattaatttcatgggaagcattgtcaaataagtgatgataaactttcttaggtggtattatgtgggtgaatgttattaatataggtgtcttaaaattatataacattcctaaaattctcatctgtgctggttatcagtcataattccaattgttatcttgaagtgttgtatgtcacggaagtagtcaaatttctttatcaattgcccttttgagtcttttgtccatttacagatagttgctgttttactctgatactttttgcttttgcaaatatgtttcatcttcagagaaagtcctggaaaggattatgacacaaagtttctcaactataggtttctgataaactttcagagtgtaaaactgaattgggtaagaaattacagaattctaacagaaaatgagctcataaatcggctaacaggagattaagctcaataatcaattatacaggactgtgtgaactgatgaggatgattataattttttaggacttctgtttgaaatattgttgagttttgatgtgttgttttgttttctcataattaaggaaatctttttctcttttctcttatgctaactatgacttacagcaatttggtgaaattatacctttatgagcaaaactgaaacatttaacttttttcccctacctgatccctccagaatttagaaactttgtgagtgagtatggttatttagtggcaatatagttatttgcataagttcaataagaatctgttctccttataacaggacacgttgattatatcaccaaagctttgactggaatgtcatatttgagaaacatacaggctcggatatgacaatactgcctttgaggaataaggttgactttctggaaataaagccgcttggaaatatgggcctggtaccttgtttacagagattctggcaatcttacccggtaagtaaggaagcttgcttatctggcaggtgcaaggaacctcagaatattttgggggccctcgagaagagaggagtccacccaaacctgtaggtactgcaggcaaaatctgatggaaagtccttggcttggcttttctggcctcgagaggcctttacagttcaatctgagattcctcataaaaattccagcaaagcagatttaaaaagcctgtataatcaattgctattcttgctgcacttatgtaacgaattgtaccaagttttattgaaactacacttgttttgcaaaccggtttatcttaatttgactatcttttataaaaatgaggtgattgtagagagaaaaaattatgtttcagtaaaagctatagtaggcattcatggatattagatctagctcttctcttttacaaggttcatctattactaatcataatgtctccttgtggccatccgtctgtgacacctgggagttccctggccacaatcaaactactactgcccaaatactaactagatttgccttgccacaggtggatcataaacaaaaagttccaaagttaaagtccccaacttatcgatatacacaggatggactatatcaaatttgggacgaatatatttggctcactcctactagtggtcaactcagtcaaaaggccactctatgttgggaacaaaccaatcacacctgtgatacatggactaatagcacccgacctatgggaaaaattccccattatatgtgttctcatatcatagccttaagaaatactgattagtttgggactgactgggatagacagcctgggatacgttggttagcccctaatggcactcagtggttatgtggctccaacttatggccttggctgccacctggatggattggacgacgcaccctaggcttcgtctaaatgcaaggtagaactacatttactatatctcctcctgctaacctacccaacctgcaacagtgctggtcctgctctgtcttccactggtatgaccaccttgcctcaattttccttccccaattaagaattgaaagtgccatctggcacatggaagctctaaacaaatgtactatgaaagcattaaatgatacacaacatagcctttcgctgcttgatttagaagtgtcccaaatgcataaggcagtcctccaaaaccgaatggcactggatgtcttgatggcagcacaggggggcacttgtgccattataaaaactgaatgttgtgtttatattcctgactaccatcaaaatatctctggcttcctatttgatatgatccaccaaattaagtcgatgtctgaccctaccgtatctctcaatgattggttgaactcttggtcaggtctaggtttctggactgctcccaaaaccttattcattgggttaatcatcttgcttgtatttcttattataatttgttatctatttcgttgtttgtcttccacatgtcaacaaagtttcacctcctggaccacctctcatcaaatgattctctcgtcttcagagtatctgtacaacttgtcagccttggatgccacgggcgcagccttctggtccgctgagcctcctacctgtacccatagacccatttagggacagctctatgaccttgtacagccggaagtagttacagaagactgaccatcgtccatatccccaaaagatttcacggccaaatgggttcgggggcgtttatgatgaggatttttagactacttaattttaaaacggtttatgatgagaaactttttttcctttgtcttgtacagagatgactcacatacccatgtcttaaatttagccctaaccctcaactcggagcagcagcaggagctctgactgcctgtgggtcctgtccccacaccagctctgcctgcctatgggtcctgtccccatgccagcaggggcagcagaagcggtggcagcagaagctctgactgcccatgggtcctgtcgccatgctattctatactattctctaaatgaaagagcactactgccagatcttgagagtctaagaaaactttctttcgactcctcggctcagcgaccccacatcacctgcagtgccactacagctgaatccagagtccatgcaggggttgcagtgcctgttgcagtgtccctggacgtggctgcagtgcccatgcaatggctgcagtgtcactgaaggtagatgcagtatgttgtcttggaggaagcagtggccatgaaggtggatgcagtgatcctgcagtggttgcagtgccccctgcagggtccctgaatgagtatgccgtgcccttgcagtggattcagtgccccacaaggtggatgcagtatgttatgacggatgatgcattgcccatgaaggtggatgcagtgattctgcagtgattgcagtgaacctgcagtgccacttcagctggctgcagtgttccttcaggggttgcagtgcccatttctgtgtctctgaatatgaatgcagtgtacatgcagtggatgcagagtaccaaaagatggatgtggtatgttgtgacagaggatgcagcgcccatgaatgtggatgcagtgatcctgcagtggttgcagtgcgcattcagtgccacttcagctggatgcagtgtccctgcagtcgctgcagtgcaacctgcactgtccctgaatttagatgcagtgctcaagcagtgatgaagtatgttgtgatggaggatgcagtgcccatgaaggcagatgcagtgatcctggagtgattgcagtgtgactgcagtgacacttcagctggaaccagagtcactgcagtggttgcagggcctgttgcattgtccctgaacgtggctgcagtgcccatacaatggctgcattttcactgaaggtagatgcagtatattatgatggatgatgcattgcccatgaaggtgcatgcagtgttattgcactggttgtcgtgccccattcggtgtccctgattgtggatgctgtgcccatgaatgtggatgcagtgattctgcagttgttgcagtgtccccttcaggttccctgaatgtggatgcagagtccatgcagtggaggcagtgtcacaaaaggtggatgcagtatgttgtctcggaagatgcagtgcccaccactgtgaatgcagtgagactgcagtgattgcagtgcgcctgcagtaccacttcaactgtatactctgtccctgcagtggttacagtgctgcctgcattgtcagggaatgcagatgcagtgcccaggcagtggaggcagtgtcacacaagtgggatgcagtatgttgagacagacaatgcagtgcccatgaaggtggatgcagtgatcctgcagtggtttccgtgcacatggtagtgtccctgaatgtggatgcagtgaacctgaagtggatgcagtgaacattcagtgattgcagtgcacctgcaatgccacttcagctgaatgcagtgttgctgcagtggttgcagagcccactgcaatgcccctgaatttggatgcagttcccatgcagtgtctgcagtgtgacataaggtggatgaagtatgttgtgaagcagcattcagtgcccatgaaggacaatgcagtgatcctgcagtggttgcactgcccctgcagtgccacttcatcaggatgcagtgtccctgcagtggttgcagtcccctgcattgtccctgaatttggatgcagtgtccaggctttggatccagtgtcccacaaggtgcatgcagtatgttgtgacggaggatgcagtgcccctgaagatggatgcactgtcccttcagtgctttcagtgccaatggcattatcctggaatattaatgctgtgccaatgcagtggatgcagtgtcccacaatgtgcatgctgtgtgttgtgacggaggatgtagtgcccatgaaggtggatacagtgatcctgcagtggttgcagtgccccctgaagtttatctgaatgtggttgcaggggtcatgcagtgaatacagtgttcctcatgttggatgccttttgttgtgatggagaattcagtgatcatgaaagaggatgcagtgatactgcagtcattgcagttcacatgcagtgccatttctggtggctgcagtgtccctgcagttgttgcagtgccccgttctgtgtcccagaaagtggatgaagtgtccatgcagtagttgaagtgtcccacaacgtggatgtcgtatgttgtgatagaagatgcagtgcgaacgaaggtggatgcagtgagactgtgctgaatgcagtgcacctgcagtgcaacttcagctgtatgcagtgtccctgcagtggttggagtgccctgttctgtgtcccggaatgtggatgcagtgtccatgcagtggttgaagtgcccccagctttgtcctggaatgtggatgcagggtcatgcagtggatgcagtgtctcacaaggtggatgcagtatattttgtcagaggatgcagtggccatgaaggtggatgtggtgaacctgcagtggttgcagtgtcccctacagtttccctgaatgtggatgcagtgcccatgcagtggatgcattgtcccacaatgcgcatgcagtatgttgttatggaggattcagtgatcatgaatgaggatgcagtgatcctgcgttcattgcagtgcacctgcattgcctcttcagcaggcttcagtgtccctgcagtggttgcagtaccccattctgtgtccctgaatgtggatgcagagcccatgcagtggatgcagagtaccaaaagttggtttccatatgttatgacaaaggatgcactgcccacgagttggatgcagtgagctggcagtgattgcagaacgccttcagtgccacttcagctggatgcagtgtccctgcagtggttgcaataccccctgcattgtcctggaatgtggatgcagcgctcatgcattggatgcagtgtcccacaatgtggaagcattgtggtgtgttgtactatgcagtgccgatgaaggtgaatgcaggcatcctgcagtggttgcagtgtgcctgcagtgccacttcagctggatgcagtgttgctgcagtgccctctgcattgtcctggaatgtggatgcagtggccaggcagtggaggcagtgtcccacaagttggatgcagtatgttgtgatggaggatgccatgcccatgaaggtggaggcagtgatctcccagtggttgcagagctccatgcattttacctgaatgtggatgcagtgctcatgcagtggatgcagtgtcccgcaaggtggatgccttatgttgtgatggaggattcagtgatcatgaaggaggatacagtgatcctgcagttattgcagtgcacctgcattgccacttcacctggctgcagtgtccctgaagtggtagcagtgccccgttctgtgtccctgagtgtggacgcagtgcacatgcagtggatgccgtgtaccaaaagttggttgccgtatgttctgacagaggatgcagttcccacgagttcgatggagtgagctggctgtgattgcagtacagcttcagtgcaacttcagctagatgcagtgttgcttcattggttgcagtttgccctgcattgtccgggaatgtggatgcagtgcccaggcagtggattcagtgtcgcacaaggtggaagtagtatgttttgacggatgatgcagttctcatgaaggtggatccagtgtccctgcagtgcttgcagtgcccgccacacgcagattcagtagtcatgggtggattcagtagtcatgcagtggatgcagtgtcccacattttggatgccatatgttgtgactgagtatgcatggcccacgaatgtggatgaagtaatgctgcagtggttgcagtgctccctacagttcccgaaatgtggatgcagttcccatgcagtagttgcagtgtcccacaagatggatgtcgtatgttgtgatggaagctgcagtgcccacggaggtggattcagtgagcctctcatgaatgcagtgggcctgcaatgcgacttcagctgtatgcagtatccctgcagtggatgcagtgccatctgcattgcccgagaacgtggatgcagtgccaaggcattggaagaagtgtcccccaaggtggatacagtatgtaatgacggatgatgcagttctcatgaaggtggatacagtgtccctgcagcaatagcagtgcccctgcattgtctgggaatgtggatgcagtagtcctgctttggatgcagtgtcacacaaggtggatgcagtatgatgtgatgaaggatgcagggcccatgaaggtggatgcagtgatgctgcagtggttgctgtgtcccctacagttccctgaatgtggatgcagtgcccttgcagtagttgcagtgtcacacaaggtggatttcgtatgttgtgatggaagatgcagtacccacgaaggtggatgcagtaaacatgtgctgaatggagtgcacctgcagtgcaaattcagctgtatgcagtgtccctgcagtggttgcagtaccaactgtgttgtccgagaacgtggatgcagtgcccaggcattggatgcagtgtcccacaaggtgcatgctgtatgttgtgatggagtatgccgtgcccatgagggtggatgcagtgatctggcagtggttgcagtgcaccctgctgtgtcctgaatgtgcatgctctgaacatgcagtgaatgcagtgatcctgcagtgattgcagtgcgcctgcatttccacatcagctggatgcagtatccatgcaggagttgctgtgccagcttctgtgtcgctgagagtgaatgcagtggatgcagtgtacctaaagtttattgcattatgttttgacaaaggacgcattgcccaagaagggggatgcagtgtccctccagtggttgcagtgcccccggcatggtccagaaatgttgatgcagtgcctatgcagtggatgcagtgaatcttcagtgattgcagtgctcctgcagtgccacttcagctggatgcagtgtagctgcagtggtggcagagccccctgacatgtccctgaatgtgtatgctgtgcccatgcagtgtctgcagtgtgactcaaggtggatgcagtatgttgtgaagtaggattcagtgcccatgagggacgatgcagcgattctgcagtcattgcagtgcacctgcaatgccacttcatctggatgcagtgcccctgcagtggctgcagtgcaccctgctgtgttcctgaatgtggatgctgtgaacatgtggtggatgcagtgaacctgcagtgattgcagtgcgactggatttcctcatcagctggaagcagtgttgctggagtggattcactgccaccttctgtgtccctgaaggtgaatgcagtgcacatgcagtggaggcagtgtacctaaaggtttatgcaatatgttttgatagaggatgcagtgcgcatgaaggcagatgcagtttccctgcagtggttgcagggcacccggtattctgctggaatatggatgctgtagtcttgcagtggatgcagtgtcccacaaggtgaaacgagtatgttgttacggaggatgcagtgcccatgaatgtggatgcagtgatcctgcagtggttgcagtgtgcatgcaatgccacttcagctggatgcagtgtccctgcagtcgctgcagtgcaacctgcactgtccctgaatttagatgcagtgctcaagcagtgatggagtatgttgtgatggaggatgcagtgcccacgaaggtggatgcagtgagcctgcagtgattgcagtgcacctgcattgccacttcagctgaatgcagtgtttctgcagtggttgcagagccaactgcagtgtccttgaacgtggatgcagtccccatgcagtggatgcagtgtcccacaatgtgcatgcagtatgatgtgacagaggatgcagtgctaatgaaggtggatgcagtgatcctgcagttgttgcagtgccccctgcagtttacctgcgtgtggatgcagtggtcatgcagagcatgcagtgtccctcaagttggatgtcttttgttgtgatggaggattcagtgatcatgaaggaggatgcagtgaacctgcagtcattgcagtgcatctacagtgccacttcagctggctgcagtgtcactgcagtgcttgcagtgcatcgttctgtgtccctgagtgtggatgcagtgcccattcagtggatgcagagtaccgaaagttggttagcatatgttgtgacaggggatgcagtgcccacgagttggagcagtgagccagcagtgattgccatatgccttcagtgacacttcagctggatgcagggtccctgcagtggttgcggtgcccccagcattgacctagaatgtgggtgcagtgct

SEQ ID NO: 71 - DNA, 7622 bp, Equus caballus
gtggaatccaatggctctcgcaaggtgactggcaggggcacctgcagtttcccattttcagctggcagcaagtgttgcctgcagtgggtcgcagtacccacgcattgttccgggagtgtggaggccagtgtcttggcagtggaatgccagtgttccccccacgttggatgcagtgtcccacaaaggtggaatgcagtatggttatgacagatgttgcagttttcctgaaaggtggaggccgttgtctcctccagtgcttgctgtgccacccacatttgtccaggaatgtggatgcagtagtcatgcagtggatgcagtgtcccacaatgtgcatgcagtatgttgtgatggaggatggaggggccatgaaggtggatgcagtgattcagctgtggttgcaatgcaccctgctgttttccagaatgtggatgctgtgaccatgcagtggatgcagtgatcctgcagtgattgcattgcgcctgcatttggtcatcagctggaagccgtgttgctgcagtgcttgcagtgacagcttctgtgtccctgacagtgaatacagtgcccatgcagtggaggcagtgtgcctaaaggtttatgcagtatgttgtgagggaggatgcagtgcgcattaaggtggatgcactgtccctgtagtggttacagggcccctggcattgtgctggaatgaggatgcaggggtcatgcagtggatgcagtgtctcacaaggcagatgtagtatgtcttgacagaagatgcagtgcccatgaaggtggatgcagtgatcttgcagtggttgcagtgtcccatgcagtttacctgaatgtggatgcagtgctcatgccgtggatgcagtgtccctcaaggtggatggcttatgatgtgttggaggattcagtgatcatgaaggaggatgcagtgatcctgcagtgattgcagtgcgcctccatttccacatcagctggaagcagtgtccctgctgtgattgctgtgccccgttctgtgtccctgagtgtggatgcagtgcccatgcagtggatgctgagtaccaaaagttggttgccgtatgttgtgacagaggatgcagtgtccctgagttggatgcagtgagccggcagtgattgccgtacgccttcagtgccaattcagctggatgcagtgtcccagcagtggttgcagtgcccacagcattgtgtgcgaatgtggatgcagtgcccaggcatcggatgaagtgcccaacaagatgcatgcagtatgttgtgatggagaatgcagtgcccatgaaggtggatgcagtgtccctgcagtggttgcagggcccatgccattgtcctggaatgtggatgcaggggtcctgcagtgtttgcagtgtctcacaagtcagaagcattatgttttgtggtaggatgcagtgctcatgaatgtggatgcggttaacctgcagtggttgcagtggccccaacattttccttgaatgtggatgcagtgcccatgcagtgcatgcagtgtcccacatggtggaggtgacatattttgagggaggatgcagtgcccacgaaggtggatgaagtgagcctgcagtgattggagtgcacctgcagtgccacttcagctggatgcagtgttgatgcagtggttgcagagccaactgcagtgtactttaacgtggatgctgtgcccatgcagtggatgcagtctcccacaatgtgccttgcggtatgatgtgatggaggatgcagtgctaatgaaggtggatgcagtgatcctacagtggttgcagtgccccctgcagtttacctgcatgtggatacagtggtcgtgcagtggatgcagtgtccctcaagttgggtgccttcagttgtgacagaggattcagtgatcatgaagaaggatacagtgatcctgcagtcattgcagtgcacctgcagtgtcacttcagctggctgcagtgtccctgcagtagttgcagtgccccgttctgtgtgcctgagtgtggatgcagtgcccatgcagtggatgcaaagtaccaaaagttggttgttgtatgtactcacagaggatgcagtgaccacgatttggatgcagtgagccggcagtgattgcagtacgccttcagtgccacttcagctggatgcactgtccatgcagtggttgcaatgccccctgcattgacctgcaatgtggctgcagtgctcatgccgtggatgcagtgtcccaaaatgttgatgcattgtggtgtgttatagtatgcagtgccgaggaaggtgaatgcagtggtactgcagtgagggaagtgcacctgcagtgccacttcagctggatgcagtgttgctgcagtacttgcagtgccccctgccttctccgggaatttggatgccgtacccaggcagtgcatgcagcgacccacaaggtggatgaaatatgttatgacggatgatgcagttctaaggaagatggatgaagtgagcctgtgctgaatgcagtgcccctgccatgcgaattcagctgaatgcagtgtccctgcagtggttgcagtgcccactgatttgtccgagaacatgaatgcagtgccagggcagtgcatgcagtgacccacacggtggacgcagtatgttatgccggatgatgcagttctcatggaggtggatgcagtgtctctgcagtgcttgctgtgtacgccacattgtccgggaatgtggatgcagtagtcatgcagtggatgcagtgtcccacatggtggatgcagtatgttgtgatggaggatgccgtgcccacgaaggtggatgcagtgtacctaaagtgatttcagtgcacttgcagtgtcacttcaggtggatgcagtgttgctgcggtggttgcagagccaactgcagtgttcctgaacgtggaagaactgcccatgcagtggatgcagtgtcccacaatgtgcaagcagtacgtcctccggaggatgcagtgcccatgagggtggatgcagtgatcctgtagtggttgcagtgcaccctgctctgtcccggaatgtgcatgctgtgaacatgcagtggatgcagtgatcctgcagtgattgctctgcacctgcatttccacagcagctggaagcagtgtacctgcagtggttgcaatgccccctgcattgtcctggaatgtggatgcagtgctcatgcagtggatgcagtgtcccacaatgtggaggcattgtggtgtgttgtagtattcactgctgatgaaggtgaatgcagtggtcctgcagtgatggcagtgcacctgctgtgccacttcagcgcaatgcagtgttgctgcagtggttgcagtgccccctgcattgtccggtaatgtggatgtagtgcccaggcagtggatgcagtgccacacaaggtggctgccctaggttatgttggatgatgcaggactcatgaaggtgggtgcagtgtcctgcagtgcttgcagtgccctccacattatcggggaatgtggatgcagtgcccatgcagtagttgcagtgtcccacaaggtggaagtcgtatgttgtgatggaaatgcagtgcccacggaggtggatggagtgagcctgtgctgaatgcagtgtgcctgcagtgcaatttcagctgtatgcattgtccctgcagtggttgcagtgcacactgcattgtcccagaacgtgaatgcagtgcccaggcattggatgcagtgtcccacaaggtgcatgcaatatgttgtgatggagtatgcattgcccatgagggtgggtgcattgatggggcattagttgcagtgcaccctgctgtgtccctgaatgtgtattctctgaacatgcagtggatacagtgatcctgcattgattgcagtgcacctgcatttccacatcagctgccagcagtgtctgtgcaggggttgccgtgcctccttctgtgtctcttaatgtgaatgcagtgcccatgcagtggaggcagtgtacctaaaggtttatgcagtatgttgtgagggatgatgcagtgcccatgaagggggatgcagtgtccctccagtggttgcagtgcccccggcattgtcctgaaatgttgatgcagtgcctatgcagtggatgcagtgaatgttcagtgattgtagtgctcgtgcagtgccaattcagctggatgcagtgtagctgcagtggttgcagagccccatgccatgtctctgaatgtggatgctgtgcccaagcagtgtcttaagtgtgattcaaggtggatgcagtatgtggtgaagtaagattcagtgcccatcatggacgatgcagtgatcctgcagtcattgcagtgcacctgcattaccacttcatctggatgcagtgcccatgcagtgaatgctgagtaccaaatgttgattgccatacattgtggcagagtttgcagagccctggagttgtatgcagtgagcaggcagtgattgcagtatgccttcagtgcaaattcaggtggatgctgtgtccctgcagtggttgcaatgcccactgcattgtcctggaatatggatgcagtgctcatgcagtggatgtgctgtcccacaatgtggaggcattgtggtgtgttgtagtatggagtgccgaagaaggtgaattcagtgatcctgcagtgatggcagtgcacctgcagcgccacttcagctggatgcagtgttgctgcagtggttgcagtgccccctgcattgtccgggaatgtggatgcagttccccggcagtggatgcattgtcccacaaggtggatgcagtatgttatgacggatgatgcagttctcatgaaggtggatgcagtgtcccttcagtgcttgcagtgccccccgcattgtccgggaatgtggatgcagtggtgatgcagtggatgcagtgtcacacaaggtggatgcagtatattgtgatggaggatgcagggccccttaaggtggatgctgtgatgctgcagtggttgcagttcccccctacagttcacagaatgtggatgcagtgcccatgaagtagtggcagtgacccacaaggtggatgtcgtatgttgtgatcgaagatgcagtgcccacgaagttggatgcagtgagccagtgctgaatgcagtgcacctgcagtgcgacttcagctgtatgcagtgtccctgcagtgggtgcagtgccgactgcattgtccaagaacttggatgcagtgcgcagccattggatgcagtgtcccacaaagtgcatgcagtatgttgtgactgaggatgcagtgcacctgagggtggatgctgtgatccggcagtggttgcagtgcaccctgctgtgtctctgaatgtgcatgctctgaacatgaagtgaaagcagtgatcctgcagtgattgcagtgcacctgcatttccacataagctggaatcagtgtccctgcaagggttgcagtgccaccttctgtgttgctgaaggtgaatgcagtgcccatgcagtggaggcagtgtacctaaaggtttatgcagtatgttgtgatggaggatccagtgcccatgaagggggatgcagtgtccctccagtggtggcagtgctcccagcattgtcctgaaatgttgatgcagtgcctatccattggatgcagtgaatcttcagtgattgcagtgtgcctgcagtgccacttcagctagatgcagtgtccctgcagtggatgcagtgtccctgcatttccacatcagctggaagcagtgtccatgctgtgcttgcagtgccccattttgtgtccctgagtgtggatgcagtgcacaagcagtggatgcagagtagcaaaagttggttgccgtatgttgtgacagaggatgcagtgtcccctagttggatgcagtgagctggcagtgattgccgtacacattcagtgccacttcagctcgatgcggtgtccctgaagtggttgctgtgcccactgcattgtgcgagaatgtggatgcagtgcccaggcatcggatgcagtgacccacaatgtggatgcagtatgttgtgacggagaatgcagtgcccacgatattggatgcagtgagcaggtagtgattgcaatgcacctgccattccacttcggctgcatgcgctgtcacagcatggttgcagtgccccgttctgtgttcctgaatgtggatgcggttcccatgcagaggatgcagagttccaaatgttggttgccgtatgttgtgacagatgatgcagtgccctagagttggatgcagtgatcctacagtgattacagtgcatcttcattgcctctgaagctgaagccagtgtccctgcagtggttgtagtgccccctgcattgtccctgaatgtggatgcagtgcctatgcactggatgcagtgtcccaaaaggtgcatgcagtatgttgtgagggaggatgcagtgcacatgagggtggatcccctgatccagcactggttgcagtgcaccctgctgtgtctctgaatgtgcatgctgtgaacatgcagtggatgcagtgatcctgcagtgattacagtgcacctgcatttccacatcagctggaagcagtgtcactgcagtggttgcagtgccaccttctgtgtccctgaaggtgaatgcagtgccaatgcagtggatgcagagtacctaaaggtttatgcagtatgttgtgaaggaggatgctgtgtccatgaagttggattcagtgtccctgcagtcgatgcattccccctggcactgtccaggaatttggaagcagtcgtcatgctgtggatgctgtgtttcacaaggtggatgcagtatgttttatcggaggatgcagtgcccatgcagtggatgcagagtaccaaaagttggttgacgtatgttgcaacagaggatgcagtgcccaagagttggatgcagtgagccagcagtgattgccatacaccttcagtgccacttcagctggatgcagtgtcgctgcaggggttgtaatgcccactgaattgtcctggaatgtggatgaagtgctcatgcagtggatgcagtgtaccacaatgtggaggcattgaggtgtgttgtagtatgcagtgccgatgaaggtgaatgcaatgatccttcagtgatggcagtgtgcctgcagtgccacttcagctggatgcagtgtacctgcagtgtttgcagagcggcctgccatgtgactgaatttggatgcagtgcccatgcagtgtctatagtgtgacccaaggtggatgcagtatgttgtgaagagggactcagtgcccaagaaggatgatgcagtgatgctgcagtgattgcagtgcacctgcagtgaccctgaatctggatgcagtgcccatgctgtggatacagtgtcccacaaggtgcatgcagtatgttgtgactgaggattcagtgcccctgtgggtggatgcagtgatccggcagtggttgcagtgcaccctgctgtgtccctgatgtggatgctgtgaacatgcagtggatgcagtaatcctgcagtgattgcagtgtgactgcatttccacatcagccggaagcagtgctgctgcagtggttgcagtgacgctttctgtgtctctgaaggtgaatgcagtgcccatgcagtggatgcagtgtacctaaagggttgtacagtatgttgtgacggaggatgcagtgctcatgaaggtggat

SEQ ID NO: 72 - DNA, 30216 bp, Equus caballus
ggatgcagtgtccctgcaggtgtttggagtgcccctcggcatttgtccctgagatggagattgcagagggtcatgtagggcatgtatgtcccacaaggtggatacagttatgttgtcacggaggatgcagtgcccacgaaggtggatgcactgaccctgcagtgattgcaatgtgcctgccatgcaacttcagctggatgcagtgttgctgcagtggttgcagtgccccatgcagtgtacctgaatgtggatgcagtgctcatgcagtggatgcagtgtcccacaaggtgaatgccttatgttgtgttgtaggattcagggatcatgagggaggctgcagtgccccgtgcagtcattgcagtgaacttgcagttccagttcagctggctgcagtgtccctgctgtggttccagtgccccgttctgagcccctgaatgtggatacagtgcccatgcagttgatgcagagtaccaaaagttgattgctgtatcttgtgatagagtatgcagttcccacgagttggatacagtgagccagcagtgattgcagtatgccttcagtgccacttcacctgaatgcatggtccctgcagtggttgcaatgacccctgaattgtgctggaatgtgtatgcagtgctcatgcagtggatgcagtgtcccacaatgaggggggattgtggtgtgatgtatatgcagtgccaaagaaggtgaatgcagtgatcctgcagtgagggcagtgcacctgcagtgccacttcagctggatgtagtgtcactgcagtggttgcagtgccccctgcattgtccaggaatgtggttgcagtgccgagacagtgaatgcagtgtcccacaaggtggatgcagtatgttatgacggatgatgcagttctcatgaaggtggatgcagtgtccctgcagtgcttgcagtgcccccagcattgtccgggaatgtcgatgcagtagtcatacagtggatgcagtgaaccacaaggtggatgcagtatgttgtgatggagggtgcggggcccatgaaggtggatgcagtgatgctgcagtggtagcagtgccccttacagttccctgaatgtggatgtattgcccatgcagtagttgcagtgtcccacaatgtggatgtcgtacgttctgatggaagatgccatgtccacgagttcgatgctgtgagacagtgtggagtgcagtgcacctgcagtgtgacttcagctgtatgcagtgtcccttcagtggttgccattccgactgcattgtctgagaacgtgcatgcactaccacggcattggatgcagtgtcccacaaggtgcatgcagtatgttgtgatggaggatgcagtgccgataaaggtggatgcagtgatcctgcagtgggtgcagtgcaccctgctttgtgcatgaatgtggatgctgtgaacatgcaggggatgcagtgatcctgcagtgattgcagtgcacctgcatttccacatcagctggaagcagtgtccctgcaggggttgcagtgccaccttctgtgtcccctaaggtgaattcagtgcccatacagtgtatgcagtgtacctaaaggtttatgcagtatgttgttatggatgattcagtgcccatgaaggtggatgcagtatccctgcagtggttgcagtgcccccggcattttcctggaatgttgatgcagtggcaatgctgtggatgcagtgaaacttcagtgattggagtgtgcctgcgctgccacttcacgtggatgcagttgtcatgctgtggatggagtgtctcacaaggcggatgcacaatgttttgtcggaggatgcagtgcccatgaaggtggatgcggtgaacctacagtggttgcagtgccacctacagtttccctgaatttggatgccgtgcccatgaagggcatgaagtgtcccacaaggtggatgcagtatgttgtgacggaggatgcagtgaccacaaacgtggatgcagtgagcctgcagtgattgcagtgcacctgcagtgccacttcagatggatgcagtgttgtgcagtggttgcagacacaactgcagtgtccctgatcgtggatgcagtggccatgccgtggatgcagtgtcccacaatgtgcatgcagtatgttgtgaaggaggatgcagtgcccatgaaggtggatgcagtgatcctgcagtggttgcagtgccccatttttgtccctgaatgtggatgctgttcccatgcagtggatgcagattaccaaaagttggttgccgtatgttgtgacagaggatgcagtgcccatgataaggttgcagtgagccagcagtgattgctgtatgccttcagtgccacttcagatggatgaagggtcgctgcagtgtttgctatgcccactgcattgtcctgcaatgtggatgaagtgctcatgcagtggatgaagtgtcccacaatgtggatgcattgaggtgtgttgtagtacgctgtgccattgaacgtgaatgcagtgatcctgcagtgattgcagtgcgactgcagtgccacttcagctggatgcagtgtagctgcagtggttgcagagcagcctggggtgtgtctgaatgtggatgcagtgccaaggcagtggatgcagcatcccacaaggtggatgcagtatgttatgatggatgatgcagttctcatgaaggtggatgcagtgtccctgcagttcttgcaatgccccccgcattgtccgggtgtgtggatgcaggagtcatgcagtgtatacagtgtaccaaaacgtggatgcagtatgttgtgatggagagtgtaggccccatgaaggtggatgcagtgatgctgcagtggttgcactggcccctacaattacctgaatgttgatgcattgcccatgcagtagttgcagtgtcccacaaggtgggtgttctatgttgtgatggaagatgcagtgcccaagaaggtggatgcagtgagcaggtgctgaatgcagtgcaccttcagtgcgacttcagctgtatgcagtgtcccttcagtggttgcagtgtccactgcattgtcggagaacgtggatgcagtgcccaggcattggatgcagtgtcccacaaagtgcatgcagaatgttgtgagagaggctgcagtgcccatgaaggtggatgcagtgatcctacagtggttgcagtgccccattctgtgtccctgaatgtggatgcagtgtccctgctgtggttgcagtgcccctggcattgtcctggaatgttcgtgcagtgccaatgcagtggttgcagtgaaacttcagtgactggagtgcgcctgcagttccacttcagctggatgcagtggtcatgcagtggatgcagtgtctcacaaggcagatgcactatgtttcgttggaggatgcagtgcccatgaaggtggatgaggtgaacctacagtggtttcagtgccccctacagtttccctgaatgtggatgcagtgcccaagcagggcatgcagtgtcccacaaggtggatgcagtatgttgtgacgaatgattcagtgcccatgaaggtgatgcagtgtccctgcagtggttgaagtgcaccctgctgtgtccctgaatgtggatgctgtgaacatgcagtgcatgcagtgatcctgcagtggtcacagagcgcctccctttccacatcagctggaagcagtgtccctccagtggtttcagtgccccctacagttccctgagtgtggatgcattgccctttcagtagttgcagtgtcacacaaggtggatgtcgtatgttgtggtggaagatgcagtgcccatgaaggtggatgcagtgtccctgcactggttgcagtgcaaccggcattgtcctggaatgttgatgtagagccaatgcagtggatgcagtgaaacttcagtgattgcaatgagcctgcagtgccacttcagctggatgcagtgcagctgcagtggttgcagaacggcctgccatgtgcctgaatgtggatgcagtgcccatgcagtggatgcagtgtcccacaaggtgcatgcagtatgttgtgatggaggatgcagtgcccatgagggtggatgcaatgatccggcagtggttgcagtgcaccctgctgtgtccctgatgtggatgctgtgaacatgcagtggatgcagtgaccctgcactgattgaagtgctcctgcatttccacatcagttggaagcagtgtccctgcagggtttgcagtgccaccttctgtgtccccgaaggtgaatgcggtgcccatgtagtgaatgcagtgcacctaaaggtttatgcagtatgttgtgatggaggatgcagtgcccatgaaggtggatgcagtgaccctgcagtggttgcagtgtacctgaatgtggatgcagtgctcatgcagtggattcagtgtcccacaaggtggatgtctcatgttgtgttggaggattaagggatcaggaaggaggatgaagtgctcttacagtatttgcagcacatctgcagtgccaattcagctggttgcagtttccctgcagtggttggggagccccgttctgtgtctctgaatgtggatgcagtgcccatgcagtggatgaagagtaccaaaagtttgttgccatattttgtgactgaggatgcagtgcccacaagtcagatgcagtcatccagcagtggttgcagtacgccttcagtgccaattcagctgaatgcagtgtccctgcagtggttgcaataccccctggattgtccgggaatgtggatgcagtgctcatgcagtggatgcagtgtcccagaatgtggaggcattgtggtgtgttgtactatgcagtgccaatgtagttgactgcagtgattcaacagtgatggcggtgtgcctgcattgccacttcagcttaatgcagtgtccctgcagtggttgcagtgccccctgcattgtccgggaatgtggatgcagtgcccaggcagtggatgcagtgtcccacaagctggatgcagtatgttatgacggatgatgcagttctcatgaaggtggatgcaatgttcctgcagtgcttgcagtgccccctgcattgtgcgtgaatgtggatgcagtagtcatgcagtgggtgcagtgtctcacaaggtggatgcagtatgttgtgatggagggtgcagggcccatgaaggtgtatgcagtgatgctgcagtggtagcattgcccccctacagttccctgaatgtggatgcattgcccatgccgtagttgcagtgtccgacaatgtggatgctgtatgttctgatggaagatgtagtgcccaagaagttggatgtagtgagctgatgctgaatgcagtgcacctgcagtgcgacttcagctgtatgcagtgtcccttcagtggttgccatgcccactgcattgtgcgagaacatggatgcagtgcccaggcattggatgcagtgtcccacaaggtgcatggagtatgttgtgatggaggatgcagtgcccatgaaggtgcatgcagcgatccagcagtggttgcagtgcaccctgctgtgtccctgaatgtggatgctgtgaacatgcagtggatgcagtaatcctgcagtgattgcagtgcgcctgcatttccacatcagctggaagcagtgtgcctgcaggggtggcagtgctgccttctgtgtccccgaaggtgaatgcagtgaccatgcagtgaatgcagtgtacctaaaggtttatgcagtatgttgtgctggaggatgcagtgcccatgaagatgaatgccgtttccctgcagtggttgcagtgcccccggcattgtcctggattgttgatgcagtgccaatgcagtggatgcattgaaagttcagtgattggagtgcacctgcagtgccacttcacctggatgcagtgttgctgcagtggttgcatagccaactgcagtttccctgaacgtggaggcagaccccatgcagcggatgctgtgtacctaaaagtttatagagtatgttgtgaaggaggatgcagtgcccatgaaggtggatgcagtgtccctgcagtggttgcagtgcccccagctttgtcctgaaatatggattcagtggtcatgcagtggatgcaatgtctcacaacggtggatgcagtatattttgttggaggatgcagtgcccatgaaggtggatgcggtgaatcctcagtgcttgcagtgccccctacaattttcctgaatgtggatgcagtgcccatgcagagcatgcagtgtcccacaaggtggatgcagtatgctgtgacggaggatgcagtgcccacaaaggtggatgcagtatccctgcagtggttgcagtgccccctgcattggccctgaatgttgatgcagtgcccatgcattggatgcagaataacccaaggtgtatgcagaatgttgggatgaaagatgtattgcccatgtaggtggatgcagtgatcctggacttgttgcagtgcaccctgcagtttacctgaatgtgaatgcactgcccatgcagcagatgcagtggcgtccaaggtggatgcagtatgttgtgatgtaggatgcagtgcccctgaaggacaatgcagtgatcctgcagtgattgcagtgtgcctgcatttccacatcagctggatacagtgcaaatgcagtggctgcaggggccacttctgtgtctctgaatgtggatgcagtgcccatgcagcgaatgaagtgtgacccaagctggatgctgcatgttgtgacagatgatgcagtgcccacgaaggtggatgcagtgtcaactgcagtggttgcagtgcccctggcattgtcctggaatgtggttgcagtagtcatgcagtgggtgcagtgtcccaatggtggatgcagtatgtcgtgaatggaggacgcagtgccaatgaaggtggatgcaatgatcctgcagtggttgctgatgctgctacaattccctgaatgtggatgcagttcccatgcattagtttcagtgtcccacaaggtggatgcagtatgttgtgaccaaggatgcagtgccgacaaacgtggatgctgtgagcctgcagtgattgcagtgtacctgcactgccacttcagcgttctgcagattccctgcagtggttgcagtgcctcctgcattgtccctgaattttgatagagtgcacatgcagtggatgcagtgtccaacaagatggatgcagtatgttatgacggatgatgaagtcctcatggaggtggatgcagtgtgcctgcagtgcttgcagtgccccctgcattgtctgggaatgtggatctagtagtcatgcagtggatgcaatgtcccccaaggtggatgcagtatgttgtgatggagaatgcagggcccatgaaggtggatgcagtgagcctgcagtgtttgcagtgcacctgcagtgccccttcggctgtatgcagtgtccctccagtgtttgcaatgccccccgcattgtccaggaatgtggatgcagtagtcatgcagtggattcagtgtcccacaatgtggatgcaggttgttgtgacggaagatgcaaggtgaatgaatgtggatgcagtgatgctgtagtggttgaattaccccctacaattccctgaatgtggatgcagttcccatgcagtagttgcagtgttccacaaggtggatgcagtatgttgtgacataggatgcagtgcccatgaaggtggacgcagcagtgccaaagccacatgccagctaggcctgaaccaagtacctgtcacacttgaatcacaggtcagcctcacttgaagcacgtgtcagccacactggcacaacttgcctgccatgccagaaccacgtgccaaacaagccacaaacacatgtgagccaggctttagcagcacctcggccgtgcatgagctacactggagccatgtgtgagccatgcgtgacaaaagcctgaatcatgtgtcagtcacatgggagccagtgctgtggcactcctgcatcatgtgtgagccatggctgagctatgcctgaaacacgtgtgaatgtgtcttctaccacatgtgacccacacatgtcgtgtgtgagccacagctgcaatacaaccaaatcatgtgtgagccctacatgaaccacatgtgagacaccctgaagcaaatctgaagcacctgtgaaacacacatgatcgatgcttgaactgcacatgaaccacaggggaggcacacatgaaacacaggtgagccatgcgggagccacgtgacagccatgactgagtatgtgggagccaggtttcaaaaacatgtgagtcatgtggcagccacatctgtatggcatgtcacacacatgtcaccacatttctgccacacatggatcctgtgcgatgcatgcctgagtcacgggtcagccatgcctgagacatcagtcagccataccggagccatgttgcaaagatgcctgaatcgcatgtcagcaactcctgtaccacatgcctcccatgcgtgcaccaagcaccagccacccctgaagcacacaaaggccatgcatgaagcatgtgtgacccacaccagagtgacatgtcatgcacgcctgtctcacgtgtcttcctcacctgagtcatgtgtcagccacacctgaataaactgtgaggcactcctgagtcacggctcagcagtgccgaagtcacgtgccagcccatcctgaaccaactgccagtcacacttgaaccacaggtcagcctcactcaaagcacatgtcagccacactggcaaaacttgcatgccatgccggaaccacgtgccaaccatgccacaaaaacatgtgagccacgcctgagcaacaccacagccatgcatgagccactcctgagccttctgtaagccaagcatgacaaaatcctgaatcacgtgtctgccacatgggtgccagtgctgtggcatgcctgcatcatctgggagccatggctgagctatgccttaaccaccagtgaaagtgtcttctacaatatgtgacccacacgagtcttgtgtgagcaaggcctgaattacagccgaaccatgtgtgagccatgcatgaaccacatgtgagacacccttgaagcacatctgaaccaactgagaaacacacatgatagatgattgaacagcacattaactgcaggggagccacacatgaaacacagctgagccatgcaggagccatgtgccagccatgagtgagtaagcaggagccaagtttcagcaacctgtgagtcacgtgggagccacacctgtacagcatgtcacacacacgtgaccacatgtctgccacatatggatcctgtgcgatgcatgcctgagtcacgtgtcagccatgcttgagacatgtgtgagccacaccagggtcatgtttcacacatgcctgggtcacatgtcggccacgactgaaccacctgccacccatgcatgaaccctgcaccagccacccctgaaacacatgaaggccatgcatgagccatgtgtgaaggagacccaggtgacatgtcatgcacgcctgtgtcatgtggccacctcacctgagtcatgtgtcagccacgcctgcatgatgtgtgagccacacctgagtcacatctcagccatgctgatatcatgtgccagcctgtcctgaaccaagtgccactcacacttgaaccacacatcagcctcactcgaagcatgtgtcagccacactggcacaacttgcctgccatgcctgaaccacgtgaaaaccatgccacaaacacaggtgagtcacgcttgagcagtaccacagctgtgcatgtgccacacatgagccatgtgtgagctatgcgtggcaaaagcctgaatcatgtgtcagataggtgggagccagtgctgtggcacgcctacatcacgtgtgagccatggctgagctatgccttaaccactggtgaaagtgtcctctacaatatgtgacccacaagagtcatgtgtcagccatgcctgaattacacccgaaccatgtgtgagccatgcatgaaccacatgtgagacactcttgaagcacatctaaaccacgtgtgaaacacacatgttcgatgcttgaatcacacatgacccacaatggagccacacatgaaacacagctgagccatgtgtgagccatgtgccagccatgagtgagtatgtgggagccatgtttcagcaacctgtgagtcacttgggagccacacctgtatggcaggtcacacacgggtgatcacatgtctgccacagatggatcctgtgcaatgcatgcctgagtcacgtgtcagccatgccttagaaatgtgtgagccacaccggggtcatgtttcacacatgcctgtgtcacatgtcagccacgcctgaaccaccctgacacccatgcgtgaaccatgcaccagccatccctgaaccacacgatggccatccatgagccatatgtgaaaaaacccaggtgacattgcacgccagactgtgtcacgtggcctcctgacctgagtcatgtgtcagcgatgcctgaataatgtgtgagtcatgtctcagctgtgctgttgtcacgtgacagctcggcctgaacaaactgtcagtcacacttgaaccacagttcagcctcactcgaagcacctgtcagccacactggcacaacttgcctgctatgcctgagccacgtgacaaacatgccaacaggggagccacccatgaaacactgctgagccatgtgtgagacaggtggcagccatgactgagtatgtgggagccacgtttcagcaacctgtagtcacgtgggtgccacccatgtatggcacatgactcctgcgtgatcacatttccgtcacacatggatactgggtgatgaatgcctgagtcacgtgtcagccatgcctgacacatgtgtcaggcacaccagagtcctgtttcacacatgccggagtcacatttcagccaggcctgaaccacctgccacccatgcgtgcaccatgcaccagccacccctgaaacacacgaaggccatgcaggaaccatgtgggaactacatctgcgtgatgtgtcaggcacacctgtgtcacgtttccacctcacctgagtcatgtgtcaggcaacaacgtgcgaactacgcctgtgtcaaggctcagccacgccaagtcacgtgccagccaggcctgaatccagtgccagtcacacttgaaccacaggtcagcctcacttgaagcacgtgtcagccacactggcacaacctgcctgccatgcctgaaccacgtgccgcccatgacaaaaacacatgtgagccacgcctgacaaacaccacagacatgcataagccacattggaaccatgtgtgaaccatgcgtgaccaaagcctgtatcatgtgtaagccacatgggagccagttctttggcacatctgtgtcatgtgtgagccatggctgagctatgcctgaaccacgtgtgagagtgtccttaaccatatgtgacccagacaagtcatgtgagattcatgcctgaattacacccgaaccatgtgtgagccatgcaggaaccacatgggagacacccttgaaccacatcggaagaacctgggaaatgcacatgttccattcttgaaccacgcatgaaccacaggggatcaacacatgaaacacagctgagccatgcatgagccacttggcagccatgattgagtgtgagatccacgcctgaattacaagcaaaccatgtgtcagcaatgcaggaaccacatgggagacacccttgaaccacttctgaagaacctgggaaacgcacatgttccattctttaaccacgcatgaaccacagaggagccacccatgaaacactgctgttccaggtgtgagacaggtggcagccatgactgaatatgtgggagccacgtttcagcaacctgtagtcacgtgggagacacccatgtacggcatgtgactcctgtgtgatcacctttccatcacacatgactactgggtgaggaatgccttagaaacgtgtcagccatgcctgacacgtgtgtcatacacaccggagtcctgtttcacacatgccagagtcacatttcagccatgcctgaaccacatgccacccatgcatgcaccatgcagcagccacccctgaaccacacgaaggccatgcatgaaccatgtgtgaaccacacctgcctgatgtgtcaggcacgcctgtgtcacttttccaactcacctgagtcacatgtcagccatgcctgaacaatgtgtgaaccacgcctgtgtcaaggctcagctgtgccaagtcacgtgacagacaggcttgaaccaagtgccagtcactctagaaccacatgtaagcctcacttggagcacgtgtcagccacactggcacagcttgtctgccatgcatgagtgacgttccgctcatgccaaaaacacatgtgcgacacgcctgaccaacaccacagacatgcattagccacacctgaaccatgtgtgagccctgcatgaccatagcctgtatcatgtgtcagcaacatgggagccagttctgtggcatgcctgaggcacgtgtgagccatggctgagctatgcctgaaccacctgtgagagtgtcctaaaccatatgtgacccagacgagtcgtgtgagatccacgcctgaattacaaccgagccatgcatgagccatgcaggaaccacatgggagatacccttgaaccacatctgaacaacctgtgaaacacacatattccatgctttcaccacacatgaaccacaggggagccagacatgaaacacagctgtgcaatgtgtgagccatgttgcggacatgattgagtatgtgggagccaggtttcagcaacctgtagtcacgtggtagccacccatgtacggcatgtgactcctgcgtgatcacctttccttcacacatggatactgggtgatgaatttctgagtcacatgtcagctatgcctgacacatgtgtcagccacaccagaatcctgtttctcataggccagaatcacatttcacccactcctgaaccaactgccaccgatgcgtgcaccatgcaccagccacccctgaaccacatgaaggcaatgcatgaaccatgtgtgaaccacacctgcgtgacgtgtcagccatgcctgtgtcacgtttccaactcagctgagtcatgtttcagccacgcctgaacaacgtgtgaaccacgcctgtgtcaaggctcagccacgcaatgtcacatgccagagaggagagaaccaagtgccagtcaaacttgaaccacaggtaagccacacttgaagcacgtgtcagccacactggcacaacctgaatgccattccacaaccacgtgccacccatggcaaaaacacatgtgagccacgcctgaggaacaccacagacatgcatgagccacacctgaaccatgtgtgagccatgcgtgaccaaagcctgtattatgtgtcagccacatgggagccagttctgtggaacgcatgcgtcacgtgtgagccattgctgagctatgcctgaaccacgtctgagagtgtccccaaccatatgtgacccagacgagttgtgtgagatccaagcctgaattacacccaaaccatgtgtgagccatgcaggaacaacatgggagacacccttgaaccacatgtgaaggacctgtgaaacacacatgttccatgcttcaagcacacatgaaccacaggggagccaccaatgagacacagctgagccatgcgtgagcaacgtggcagccatgactgagtatgtgggagccacgtttcagcatcctgtagtcccgtgggagacacccttgtacagcatgtgactcctgcgtgatcacctttgtgtcacacattgcaactggacgatgaatgcctgagtcaggtgccagccatgcctgacacatgtgtcagccacaccagagtcctgtttcacacatgctggagtcacatttcagccacgtgtgaaccacctgccgcccatgtgtgcaccgtgctccagccacccctgaaccacacgaaggccatgcatgaaccataagtgatccacacctgcgtgatgtgtcaggcatgcctgtgtcacgtttccacctcacctgagtcacgtgtcagccatgcctgaacaacgtgtgaaacacgcctgtgtcaaggctcagctgcgccaagtctcgtgccaaccaggcctgaacaaattgccagtcacacttggaccacaggccagcctgacttgaagcacctgtcaaccatactggcagaacttgactgccatgcctgaaccacatgccacccatgccaaaaaaacatgtgagccacgcctgaccaataccacatatatgcatgagccacacctgaaccatgtgtgagccatgcgtgaccaaagcctgtatcatgtgtcagacacatgggagccagttctgtggcacgcctgcttcacgtgttagccatggctgagctatgcctgaaccacgtgtgagagtgtccccaaccatatgcgacccagacgagtcgtgtgagatccacgtctgaattacacccgaaccatgtgtgagccatgcaggaaccacatgggagacaccctggaaccacatctgaagaaactgaaacacacaggttccatgcttgaagcacacatgaaccacaggggagccacccatgagacacagctgagccatgtgtgagccacgtgacagccatgactgagtatgtcggagccacgtttcagcaacctgtagtcccgtgggagtgacccatgtacggcatgtgactcctgcgtgatcacctttccatcacacatggctactgggcgatgaatgcctgagtcacatgtcagccatgcctgacacatgtgtcagccacactggagtcctgtttcaacatgccggagtaacatttcagccacgcctgaaccacctgccacccatgcgtgcaccatgcaccagccacccctgaaccacacgaaggccatgcatgaaccatgtgtgaatcacacctgcgtgacttgtcaggcactcctgtgtcacgtttccacctcacgagccagccaggccttttttggcgttttccacaggtgggtcctgcgagtcgagcaggtggttctggcgtgctcggcaggtggttcaggcatgtccagcaggtggttccagcctgtccagatcgtggttccgacgtgtccagcacgtggttctggcacgtctgagaggttgtgccggcatgcccagcatgtgattccagcttgtccggcaagcggttctgatgtagccagcaggtgattttggcgtgtccagcaggtggttctggggagtcgatcaggtgtttctggcatgctcggcaggtgcttccggcatctccggcacgtggtttggcatgtctgagaggttgtgcctgcatgcccggcaggtgattctggattgtccgccatgtggctctggcatagccagcaggtgatttttggcatgtctggcaggtagttctggcgagtcgaacaggtgattccgttgtgctcggcaggtggttcaggcgggcccggcatgtggttccggtcagtccaggagctggttccggcgtgtccagccacgtgtttcaggcacgtgtgagaggtggttctggcatgcccggcaggtgattccggagtgtccgccaagtcgctctggcatagccagcaggttattttggcgtgtatggcaggtggttcctgcgagtggagcaggtggttacggtgtgctcggcaggttgttgtgacgtgtccagcatgtggttccggtctgtccgggaggtggttccggcgtgtccagcacatggttctgagacgtgtgagacttggttccagcatgcccagcaggtgattccggagtgtctggcaaggggttatgctgtagccggcaggtgattatggcgtgtctggcaggtggttctggcgagtcgagcaggtggttccggcgagctcggcaggtgcttccagactctccagcacatggttctggcacgtctgagaggtggttccggcatgcctggcaggtgattctggagtttccggcaagtggttctggcatagcccgcaggttattttgacctgtatggcaggtgattcctgcgagtggagcagccggttctggcatgcttggcagttggttctggcctgtccggcacatgcttctggcatgtctgagaggttgtgccggcatgcccggcctgtgattccggagtgtccagcaagtggttctggcttagccggcaggtgattttgtcatgtccgccaggtgggtccagcaagtcgagcaggtggttctagcgtgctcgacaggaggttcaggcgtgtctggcaggtggtttctgtctgtcctgtagagggttccggctagtccggcaggtggttctggaatgcctgagaggttgattcggcatgcctggcaggtgattcccgagtctctggcacgacgttctggcattgccggcaggtgattttcgtgtgtccagcaggtggctcctccgagttgagcaggtggttccggtgtgctcggcaggtgcttgcagcatgtccggcaggtggttccggtctgtccaggaggtggttccggtgtgtctggcacgtgcttctgacacgtctgagacatggttccggcatgcccgacaggtgattcctgagtgtccgccaagtggttctggcatagccggcaggtaattttggcatgtatggcaggtggttccggccagtagagcaagtgcttccagtgtgctcgacaggtggttaatgcgtgtccaccaggtggttccggtctgtccgtgaggtggttctggcgtgtccagcacgtggttctggcacgtttgagagatggttccggcatgcccggcaggtgattccggagtgtctgccaagtggttctggcatagccggaaggtgattttggcgtgtccggcaagtggaccaggcgaatcgagccagtgattcaggcgtgctcagcaggtggttcaggcatgtctggcggttggttccggtctgtctggaggtcgttccggcgtttccgacacgtgtttctggcacgtttgagaggtggttccagcatttccggcaggtgattccggagtgtccaccaagtggttctggcatagccagaaggtgattttggcgtgtccgacaggtgattcctgtgagtagagcaggtggttccggcgtgcttggcaggtggttcatgcatgtccggcaggtggttctggtcagtccgggaggtggttcggacgtgtccggcacgtggttgtggcacatctgagaggtggttctgtgatgcccaacaggtgaatccggagtgtccaacaagaggttctggcgtatcccacaggtgattttcgcgtgtccggcaggtggttatggcgaggcgagtaggtgggtctggcgtgctcagcaggtggttccaacgtgtccggcacatggttctggcacgtctgacaggtggttctgggatgctcggcaggtgattcctcattgtccgccaagtagttctggcgtagccggcaggtggttgaggcgagtccggcagatggttccggcgagttgagcaggtggttctggcatgctcggcaggtggttcaggcgtgtccggcaggtggttctggtctgtccaggaggtggttccggcatgtcaggcatgtggttctggcacatctgagacgtggttccagcatgccagtaaggtgattccggagtgtccgccaagtggttccggcgttgccggcaggtgattttgacgtgtctggcaggtggttctggcaagtcgagcaggtggttctggcttgctcggctgttggttcaggcgggtcaggcaggtggttcggttagtccaggaggtggttccagagtgtcctgcacgtgtttcaggcatgtctgagaggtggttcaggcatgcccggcaggtgtcggccaagtggttctggggtaactggcaggtgattttgacgtgtccggcaggtggttgtagcgaggcgagtaggtgagtctggtgtgctcagcaggtggttccggtgtgtctggcacgtggttctggcacgtctgaggggtggttccggcatgcctggcaagtgattccggagtgtatgccaaatggttctggcgtacccggcaggtgattttggcgtccgactggtggtttcggcaagtcgagcaggtggttccggtgtgctcggcaggtggttccggtctgtgtgagaggtggtgccaggtgtccatcacgtgtttctggcacgtctgagaggtgggtttggcatgcccgacaggtgattccggagattccgccaagtggttctggcatggccttcaggtgatttcggtgtgtccgtcaggttgttccgttcagtccgtgaggtggttctggcatgtccttcacgtggttctggcacatctgaagggggttctgtcatgccaggcaggtgactccagagtgtcccccaagtggttctggcgtagccggcaggtgattttgctgtgtcctgcaggaggttctggcgagtcgagctggtggttccggcatgcttggcaggtggttcaggcatgtctggcaggtggttccgttctgtccgggaggtggttccatcgtgtccagcacttggttgtggcacgtctgagaggtggttctggcatgcccggcaggtgattctggagtgtccacccagaggttctggagtagccggtaggcgattttgctgtgtcctgcaggagagtccggcgagtcgagcagttgtttccggagtgctcggcaggtggttccggtctgtgcgggaggtggttccggggtgtccggcaggtggttccggcgtgtactgcacgtgtttctggcacatccgagaggtgataccagcatgcccggcaggtgattccggagtttccgacaattggttccggcgtagccgacaggtgattttggcggctctggcaggtggttccggcgagttgagcaggtcggaccggcgtgctcagcagtgggttctggcgtgtccggcacgtttttctggcacgtctgagaggtggttccagcatgcttgacaggtgattcctgagtgtccgccacatggttctggcatagctggcaggtgatttttgcatgtctggcaggggtttctggcgaactgagcaggtggttccagcgtgctcggcacgtggttgaggcgtgtccggcaggtggttccagtctgtccaggaggaggttccggcgtgttaggcatgcggttctggcacatctgagatgtggttccggcatgcccggcaggtcattccagagtgtcggtcaagtggttctggcatagacggcaggggattttaacgtgtgtggcaggtggttccagcgagtcaagcaggtagttctggagtgctcagcacattgtccaggcgtgtcctgcaggtggttccggtctgtctggcagttggttccggcatgtccgacatgtgtttctggcacgtctgagacgtggttccagcatgcccgacaggtgattccagagtgtcagccaagtggttctggcatagccggcaggtgattttggtgtatccggcatgtggttccggcaagtcaagcaggtggttccagcatgcttggcaggtgattttagcgtgtccggcaggtggttgtggcgaggcgagcaggtgggtccggtgtgctcagcaggtggttctggcgtgtctggcacgtgggactggcacatctgagaggtggttctgggatgctcggcaggagattccagagtgtccgccaagtggttcaggcatagccggcaggtggttcaagcgtgtctggcaggtggttccgtcgagttgagaaggtggtttcggtgtgctcggctgctggttccggcgtgtccgacgggtggttctagtttgtccaggaggtggtttcggcctgtccggcatgttgttctggtacgtctgagaggtggttccggcatgccctgcaggtgattttggactgtctgccacatggttctggcatacctggcaggagattttggcgtatccagaaggtggttctggcgggtcgagcaggtggttctggtgaatcgagcacgtgattctggcgtgctcgaaagatgcttccggcgtcactgtcacgtggttctggcacgtctgagaggtggttcaggcatgcccggcaggttcttcacgagtgtctgccaagtagttttggcatagccagcaggtgattttggtgtgtctggcatgtggttccggcgagtcgagcaggtgattctgacgtgctcagcaggtggttcaggcgtgtccggcagctggttctggtctgtccgggacgtggttcaggagtgtccgccaggaggttgtggtgtagccggatggtgattttggcgtgtcgagcaggtggttccagcgtgctcatcaggtggttcaggcgtgtccgacaggtgcttccggtctgtctaggaggtggttctggcatgtccggcatgtggttctggcacgtctgagaagtggtgccagcatgtccggaaggtgattctggagtgtcgggcaagtggttctggcatagccggcaggtgattttggcgtatccagtaggtggttctggcgagtcgagcaggtggttccagcatgctcggcaggtggttcaggcgtgtctgacatctggttccggtaagtccgggaggtggttccggcgtgtgcagcacgtggttctggcacgtctgagaggtggttccaggatgctcggcaggtgattctggagattccgacaagtggttctggcatatccggcaggtgattcaggcgtgtccagcaggtggttcctgcgagttgtgcaggtggttccggcgtgctcagcatgtggttcaggcaagtctggcaggtggttctggtgtggacgagaggcggttccggcacgtgtttctggcacttctgagaggaggttctggcatgcccagcaggtgattccggagtgtccgccaagtggttccggcctacccggcagttgattttgacgtgtccggcaggtgtttacggcgagtcaagcaggtggatccagtgtgctcggcatttggttccggcttgtccagaaagtggttttggcacgtcagagaggtggttccggcatgcccagtgggtgactccagtgtccggcaagtggttctggtgtagccagcaggtgattttggcgtgtctggcaagtggttaccacgagtctagcaagtggtcccaccatgctcggccagtggttcatgcaagtctggcaggtggttccggtctctccaggaggtggttccggcatgtccagcatgtggttctggcatgtctgagacgtggttccggcatgaccggcaggtgattcctgagtgtccgccaagcagttctggcgtagccggcaggacattttggcatgtcctgcaggtggttcctgcgagtcgagcaagtggttctggcgtgctcggcaggtgcttccagcatctcgggcatgtggtttggcacgtctgagaggtggttctggcatgatcgacaggtgattccagagtgtctgccaagtggttctggcatagtggcacgtgattttggcttgtccagcaggtctttctggcgagtcgaagaggtggttccggcatgctcggcaggtgcttctggcatctccggaacgtggtttggcacatctgagagcttgtgccggcaagcccggcaggtgattctggattgtcttccaagtggctctggtgtggctgtaggtgattttggcgtgtccggcaggtggttctagggagtggatcaggtggctgcggcatgcccggtaggtgattccggagtgtccgccatgttgttcctgcgtttccggcaggtgattttggcatctctggcaggtgtgtccggcggggcgagcatgtcatcctggcatgctcagcaggtcgttctggtgtgtctggcaggtggttctggtctgtctgggactggttccagcattttcagcacgtggttctggaacatctgagaggtggttccggcatgcccggcaggtgattccagagtgtccaccaagtggtttctggcgtagcaggcacgtgattttggcatgttgggcaggtggtttccggcaagtcgagcaggtgtttccggcgagctcagcaggtgcttccagcctctccagcacgtggttctggcacatctgagacgtggttccggcatgccaggcaggttattccaaagtgtccaccaagtggttctggcgtggctggcaggtgattttggcgtgtctggcaggggcttccggcgagtcgagcagatggctctggcatgctcggcaggtgattcaggcgtgtctggcagttggttccattctgtccggtaggtggttctggcgtgtccggttcgtggttctggcacgtatgagaggtgcttctggcatacccagcaggtgattccggagtgtccaccaagtggttctggcgtttctggcaggtgattttggcgtgtctggcaggtgtgtccggtgattcgagcagttgggtccggcatgtcaggcaagtggttctggtctgtctgggaggtggttccagcgtgtccggcacgtgcttctggcacgtctgagaggttgtgctggcgtgccaggcaggttattccggagtgtccggaagtgtttctggtgtagccggcaggtgattttggcggtccggcagttggttccggcgagtcgaacaggtggttctggcgtgctcagcaggtgcttctggcgtctccggcacgtggttctggcacgtctgagaggttttgccggcatgcccggcacgtgaatccggcttgtctgccacgtgtttctggtgtactcggcaggtgattttggcatgtccggtaggtgggttcagtgagtcaagcaggtggttctggcgagtctggcgggtggttccagtctgtccaggaggtggttgtggtgtgtccggagggtgcttcaggcacgtctgagtggttgtgctggcatgcccagcaggtgattccggagggtccgccattggttctggtgtagccggcaggtgattttcccatgtctggcaggtggttccggtgagtctagcaggtggttccggcgtgcccggcaggtgcttcccgcggctcaggcacgcagttctggcacattgagaggttgttacggcatgccctgcaggtgattccggattgttcagcaagtggttctggcatagacatcaggtgattttggcatgtccggcaggtgattctggcgagtcgagcaggtggttccggcgagatcggcaggtgcttccggcatctgcggcacgtagttctggcacgtttgagaggtggttacggcatgtcctgcaggtgattctggagcatctggcaagcggttctggcgtagcgttaggtgattttggcgtgtccggcaggtggttctggggagtagatcaggtggttccagcatgcccagcaggtgcttctggagtctccagcatgtggttctggcatagccggctggtgattttggcatttccggcaggttgcttccggcacgtctgagaggtgattccggcatgcccagcaggtgattctggagtgtccagcatgtggttctggcatgtctgagaggtggttccggcatgccatgcaggtgattccggagtgtctgccaagtggttctggtgtagccggcaggtgattatggcgcatccggcaggggcttctggcgagtcgagccagtggctccggcgtgcctggcaggggattcaggcgtgtctggcaggtggttccgttctgtaggtgacgtggttccggcgtgtctggcacgtggttctggcatgtctgagatgtgtcggcatgcccggcacgtgattccagcttgtccggcaagtggttctggtgtagccggcatgtgattttggcgtgtcaggcaggtggtcccggcaagtccagcaggtggttctggcgagctcagcaggtgcttccagcacgtcttagaggtggttccggcatgcccagctggtgattctggagtgtctggcaagtggttctggtgtagccggcaggtgattttggcgtgtatggcaggtggttcctgggagtggagcaggtggttctggtgtgctcggcagatggttcaggcttgtccgggaggtggttttggtctgcacgggaggtgtttccggcgtgtccagcacatgggtctggcacgtctgagccgtggttctggcatgcctggcaggtgattctgtagcatcctccaagtggttctggtgtagctggcaggtgatttttgcgtgttcagccggtgggtctggcgagtcgaacaggtggttccgacgtgctaggcaggtggttaagtcgtgtccagaaggtggttcccgtctgtgcgggaggtggttctggcgtatctggcatgtgcttccggcatgtctgagaggttgcgccagcatgcccggcaggtgattccggactgtccgccacgtggttctggcacatcggaggtggttctggcatgcccggcaggtcatcccggagaatcctccaagtggttctggcatagccgtcaggtgattttggcgtgtccagcaggtggttccggtgtgctaggcaggtggttcaggcaggtccagcaggtggttccggtctgtccgggaggttgttccggcgcatccggcacatctgagaggtggttctatcatgcccggcaggtgattcccgagtgtccggccagtggttgtggggtagccggcaggtgattttggcgtgtccggcaggtcgttctggcgagtcaagaacgtggttccggcctgctcggcaggtgtttccggcgtctccggcacgtgtttatgtcacgtctgagaggttgttccggcatgcctgacaggtgattccggagtgtccggcaagaggttctggcgcagccggcaggtgattttgccatgtccgacaggtggttctggcgattcgagcaggtggctccggcgtgctcgtcaggaggtttcagcgggtctggctggtggttccggtctgtccgggaggtggttgcggcatgtccagcacgtggttccggaatgtctgagaggtaattctggcattcccagccgatgattccagggagtcccacaagtggttctggagtagctggcaggtgatgatggcatatccggcaggtggttctggtgattcgagcaggtggctccggcgtgctcggcagggtttctggtctggccgggaggtggttccggcgtgtccggcatgtgcttctggcacgtctgggaggttgtgctggcattcccggcaggtgcttgcggagcgtccggcaagtggttctggtgtagccggcaggtgattttgccgtgtcaggcaggtattccggcgagacgagcatgtggctctggcgtgcttggcaggttcttccggtgggtccggcaggtggttccagtctgtctgggaggtggttctggcgtgtctggcacatggttctggcacgtctgacaggtggttctggcatgcccggcaggtgattccggattgtccacacagtggttccggcgtagccggcaggtgattgtggcatgtccggcagctgattctggcgagtcgagcaggtggctccggcgcgctcagcaggtgcttctggcgtctctggcatttggttctggcacgtctgagaggtggttccggcaagtgattccggagtgtcgccaaatggttctgttgtagccgacaggtgattttggcgtgtcctgcgggtggttctggggagtggatcaggtggttccgggaggcttggcaggtgcttctggcgtctctgacatgtggttcttgcacgtctgagacgtggttccggcgtgcctgaatggtgattctggactgtccgccacgtggttctggcatagccggcagttgattttggcgtgtccggcatgtggttgtggaaagtcaagcaggtggttccggcatgctcagcaggtggttcaggagtgttcagcatgtggttccagtctgtccgggagatggttcctgcatcctcggcaggtgcttccagtgtctccgccacgtacttctagcacgtctgagaggtggttccggcagacccggcgggtgactccacagtgtccggcaagtggttctggtgtagctgacaggtgattttggtgtgtctggcaggaggttcctgcgattcgaggaggtggtttcggcgagcttggcaggtgcttctggcgtctccggcacatggttctcgcacatctgagaggtggttcctgcatgcccggcaggtgattccggagtgtgcggcaagtggttctggcatagccggcaggtgattttcgtgtgtctggcaggtgggtctagggtgtcgagcaggtgggtccggcttgctcggcatgtggttcaggcgtgtctggatggtggttccagtctgtccaggaattgggtccagcgtgtccggcacgtggttctggtacgcctgagaggcggttccggcatgcccggcaggtgattctggactgaccgccacatggttctggcatagctggcagttgattttggcgtgtccggcaggtggctccgatgagtcgagcaggtggctccggcgtgcatggcaggtggctccggcgtgtgtggcatgtggttccggtctgtccggcaggtggttccagagagtcgagaaggtggttccagtgagcttggcaggtgcttccagagtctccggcatgtggttgtggcacgtctgagatgtggttccgggatgcctggcaggtgatttcggagtgtccaacaagtggttctggtgcagccagcatgtgattttggcatgtctggtaagtgggtcctgcgagtcgagcaggtgattctggcgcgctcggcaggtggttccggcgagtccagcaagtggttcctgcgtgctcggcaggtagttccagcgtgtccggcatgtatttctggcacatctgagatgtggttccagcatgccaggcaggtcattcccaactgtccgccacgtggttctgtcgtagcctgcaggtgattttggcatgtccggcaggtgtttccagcgagttgaccaggtggttctggcatgctcggcatgaggttcaggcatgtccagcatgtggttccagtctgtccgggaagtggttctggcgtgtccggcaggtggttctggtctgtgcgggaggtggtgccgaggtgtccatcacgtgtttatgagacgtctgagaggtgggtccgtcatgcccagcaggtgtttccggagtgtcctgcaagtggttctggtgtagccggcaggtgattgtgtcgtgcccggcaggtggctccggagagtcgagcaggtggttctggtgagctcggcaggtggttcaggcgtggtcggcagttggttctggactatcaggggtgtggttctggcgtctccagcacgtggttctggcatgtctgaaacgtggttctggcatgccagcaggtgattgtggagtgtccactacgtggttctcgcatagccggcaggtggttcaggcatgtccggcaggtggttctggtctttcttttaggtggttccggcgtgtgcagcacgtcaatctgagacatctcagacttggttccggcatgctcttcagatgagtccagactgtgtgccatgtggttgtggcatagtgggcaggtaattttggcatgtcctgcaggtggttccggcgagtcaagcaggtgtttccagtgtgtctgggatgtggttgcggcgtgtccggcacatggttctggtacgtctgagaggtggttccggcatgcccagcaggtgattctggaatgtccgccaattggttctggcgtagctggcaggtgattttggcatatccggtaggtggttccggcgagtcaaacaggtggttcgggcatgctcgacagctgcttcaggcatgtcgggcaagtggttccagtctgtttgggaggtggttccggcatgtccagcacgtgattctgagatgtctgagtggtggttccagcatgcccttcaggtgattccggactgtctgccaggtggtggtgacatatccggcatgtggttctgggttgtctggcacgtggttctggcatagccggtaggtgattttgaagtgtccggcatgtggttccggcaagttgagcaggtggttgtggcgtggtcggcaggaggttgagacgtgtctggcaggtgtttccggtctgtcctgcatatggttctggcacgtctgagatgtggttctgatacgccaggcatgtcattccggactgtctgccacgtggttctggcgtagccggcaggtgattttggcatgtctggcaggtgttttcgcagagtcaagcaggtggttccggcgtgtccggaacgtgtttctggcacctctgagagtttgttctggcatgaccggcaggtgattccgtaatgtccgccaagtggttctgacgtaaccagcaggtaattttggcatgtccggcaggtgattccagcgagtcgaccaggtggttctggcgtttctggcacgtggttctggcatgtctcagagctggttccagcatgcccggcaggtgattccggagtgtgtgccacgtggttgtggcatagctggcaggtgattttggcgtgtctggcaggtggttctggcaagacgatcaggtggttccagcgtgctcagcaggtggttccagcatgtggttctgtcacgtctgagaggtgggtccggcatgcctggcaggtgattccggagtgtctggaaagtggttctggcgtagtcggcaggtgattttaatgtgtccagcatgtggttccagtgagtcgagcaggtggttccggcgtgctcggcaggtggttctggcgtgtccggcaggtggttctggcatagctggcaggtggttccggtctttccgggagggggttccagtgtgtgaggcacatgtttctggcacatctgagaggtggttccggcatgcttggcaggtgattctggagtgtccgtcaagtccttctggcatagccggcaggtgattttggtgtgtccagcaggtggttccggtctttccaggaggtggttctggcgtgtccagcacgtgtttctggcacgtctgagaggtggttccggcatgcctggcaggtgattacggagtgtccgacacatggttctgacgtaaccggcaggtttttttgccgtgtcaggcatgtggttccggcaagtcaagcaggtggttccgacgtgctcggcaagtggttccggcatgtctggcatgtggttctggctcatctgcgatgtggttccggcatgcctggcaggtgattccggactgtccgccacgtggttctggcatagccggcaggtgattttgccatctccggcaggtgtttccggagagtcgaccatgtggttctggcgtgctcagcaggaggttcaggcgtgtctggcaggtatttccggtctgtccgggaagtggttccggcatgtccagcacgtagttctggaacgtctgagaggtggatccggcatgcccagcaggtgatgtctgccaagtggttctggcgtagtcggcaggtggttcaggcatgtctggcaggttgttctggtctttctgataggtggtactggcgtgtgcagcatgtcattcggagacgtctcagacttggttccggcatgcccttcaggtgattccggactgtgtagcacgtggttgtggcatagccggcagatgactttcgcgtgtctgacaggtggttccggggagtcaagcaggtggttcctgcgtgctcagcaggtggttacggcgtgtctggtatgtggtcccggtctgtccatgaggtgggtctggcgtgtctagcacgtggttctggcacggctgaaggtggttccggcatgcccgccaggtgattccggactgtcgaccaagtgcttcttgcatagccggcaggtggttcaggtgtgtccggcatgtggttctggtctttccgggaggtggttccagcgtgtctggtacgtgttgctggcacgtctgagaggtggttccggcatgcccagcaggtgcttcccgagtgtccaccaaatggtgctggcgtagccgtcaggtggttttggcgtgtctggcaagtgattccagcgagttgaaccagtggttctggtgtgcttggcaggtggttcaggcgtgtccagcaggtggttccgctctgtccaggaggtgggtctggcatgtccggcacgtggttctggcatgtctgagaggtggttccagcatgcccggcaggtgattccggagtgtccgccaagtggttatggcgtagccggcaggtgatttttgtgtgtctggcaggtggtttcgacgagtcga

SEQ ID NO: 73 - DNA, 30866 bp, Equus caballus
gttccggcatgccggcaggtgattcgggattgtctgccaagttgttctggcgtcaccagcaggtgattttggcgtgtctggcaggtggttctggtgagttgagctggtgtttacggcgtgctcggcaggtgttcctgtctgtgcgggaggtggtgccagggtttccggcacgtgtttctgttacgtttgagagatagttctggcatgcccgtcaggtaattctggactgtctagcacgtggttgtggcatagccaggaggtgattttggcgtgtccggcaggtggttccagggagtcgagcagatacttccggcatgctcagcgggtgcttccagtatctttggcacctggttctggcatgtgtgagacgtggttccggcatgcctggcagttgattctggagtgtccgcctagtggttgtggtgtcaccggcaggtgattttgcgtgtccggcggtcattccagcgagtcgaacaggtggttctggcacatgtttctggcacgtttgagaggtggtgccggcatccccaacaggagattccggagtgtatgtgcaagtggttctggcgtagccgcaggtgattttggcgtgtctggcaggtgtttccagcaagtcgagcaggtggttctggcatgctgggctggtggttcaggcgtgtcccgcagtttgttcttgtatgtcagggaggtggttcaggtgtgtccggcaggtggttcctgtctgtccgagaggtggttccagcatgcacatcaggtgattccagagagtccgtcaagtggttctggctagtcgagcaggtgcttccggcgtgctaggcaggtgcttctggcatctccggcacgtgtttctggcacgtctgagaggtggttccggcgtgcgcagcaggtgattccggactgtccgccacgtggctctggcatagccggcagttgattttggcatgtccggcaggtggttctggagttatgtccggcaagtcgagcaggtggttccagcatgaccggcaggtggttctggtctgtctggcaggtggttctggtgagtcgagcaggtgcttccagagtctgcagcacgtggttttgacacctctgagaggttgttccggcatgcctggcaggtgattccggagtgtccgacaagttggtctggcgcagccggcaggtgatttttgcatgtcccgtaggtgggtcctgggagtctagcaggtggttctgctgtgtccagcaggtggttccgctctgtccaggaggtggttccggcgtgtccggcacgtgcttctggcacatctgagaggtggttccggcatgcccggcaggtgattccggactgtccgccacatgtttccggcatagccgacagttgatttgggcatgtccagcaggtgggtctggggagtggatcaggtggttccggcatactcggcaggtggttccggcgtgtccagcacatggttctggtacgactgataggtggttccggcatgcccggcagttgaccccggactgcccgccacgtggtagtggcatacctggtaggtgattttggcgtgtccgggaggtggttacggcaagtagagcaggtggttccggcgaatcgagcaggtggttcaggagtcaatgtcacgtggttctggcacgtctgagaggtggttcaggcatgcccggcaggtgattgcagagtgtctgccaagtagttttggcatagccagcaggtgattttggcgtgtctggcaggtgtttccggcgagttgagcagatgattccgacatgctcagcaggtggttcaggcgtctccggcagctggttccggtctgtctgggacgtggttctggagtgtctgccaggaggttgtggcatagccggagggtgattttggcatgtctggcagatggccccggtgagccgagcagatggttctggcgagctcgggaggtgcttccggtgtctccggcatgtggttctggcacgtctgagatgtggttccggcatgcctggcaggtgattccggagtgtccgacaagtggttgtggcgcagcctgctgctgattttggcatgtctggtaggtgggtcctgcgagttgagcaggtggttctggcgtgctcggcaggtggttctggcgggtccggcaggtggttccggtctgtccgggaggtggctacagcatgtctggcacgtggttcccgcacatctgagaggtggttccgggctgtctggcaagtgattccagagagtccgacaagtggttctggtgtggccggcaggtgattttgttgtgtctggcaggtggttctggcgagtcaagcaggtggttcaggcctgctcggcaggtgcttccggagtctctagcacgtgtttctggcacttctgtgaggtggttctggcatgcctggcaggtgattccggtttgtccaacaagtggttctggcttacccggcaggtgattttggcatgtctggcagctggttccggcgagtcaagcaggtggttccggcgagctcggcagttgcttccggtgtctccggcacgtggttctggcacgtctgagatttggttccggcatgcccgtgaggtgataccggagtgtccggcaagtggttctggtgcagctggcaggtgattttggcatgtctggtatgtgtgtcctgcgagtcgagcaggtggttccgacatgctcggcaggtggttcagccgtgtccggcatgtggttccagtctgcacgggatgtggttctggattgtccggcaggtggttccactctgtccgggaggtggttccggcgtgctgggaaggtgcttccggcatctctggcatgtgcttctagaacgtctgagaggtggttctggcatgcccggcgggtgatcccacagtgtctggcaagtggttctgctgtagccggcaggtgattttgatgtgtccggcaggtggttctgggcagtggatcaggtggttcaggcatgctcgacacgttgttcaggcatttcaggcaggtggttctggtctgtcctgtaggtggttttggcgtgacctgcacatggttatggcatgcctgagaggtggttccggcatgcccggcaagtgatcacggactgtcccccacgtggttcgggcgtagcctgcacgtgattttggcatgtccagcaggtggttccggtgagtcaagcaggtggttccggcgtgctggggttgtggttcaggcgtgtcccgcaggttgttctcgtatgtcagggaggtggttccgacgtgtccggcaggtggttcctgtctgtccgggaggtggttccagcatgtgcggcagttgattccagagagtccgccaagtggttctggcgtacccggcagttgattttggcatgtccagcaggtggttctggggagtggattaggtggttccggcatcctcggcaggtggttctggcgtgtccggcacatggttctggtatgtctgagaggtggttccagcatgcccggcacgtgaccccggactgccaaccaggtgtttctggcataccctgccggtgattgtggcatgtccaggaggtggttacggagagtagagcaggtggttccggcgaatcaagcaggtggttccggcgtgctcgacaggtgattccggcgtaactgtcacgtggttctggcacatctgagaggttttgccggcatgcccgtcatgttattccgctttgtcttccaagtggttctggcgtacctggcaggtgattttggcatgtccggcaggtgggttcggcgagtcaagaggttggttctggcgagtctggcaggtggttccagtctgtacgggaggtggttccggcgtgtctggtgggtgcttcagccacgtctgagaggttgtgctggcatgcccggcaggtgattacggagtgtccagcaagtggttctgatgtagcctgcaggtgagtttcccatgttcggcaggtggttccggcgactctagcaggtggttcaggcgtcctcggcagttgcttacggcatctccggaacgtggttctgaaacatttgagaggtcattctggcatgccctgcaggtgattccagattgtccagcaagtggttctggcgtagccgtaggtgattttggcgtgtctggcaggtggttccggcttgtcaagcaggtggttccggcgagattggcaggtgcttctggcctctccggcacgtagttctggcacgttttagaggtggttccgttatgcctggcaggtgattccggagtgtccggcaagtggttctggtgtagccgtaggtgattttggcatgtctggcaggtagttctggggagtgaattaggtgtttccagcaggatcggcaagtgcttccagagtctccagcatgtggttctggcgtagctggctggtgattttggcgtgtttggcaggtggttccagcgagttgagcaggtggtcccagcatgctcgtcatgtggttcaggggagtctggcatgtggttccagtctgtctgggaggtggttccggcgtgtccggcacctgcttccagcacttctgagaggtgtttccggtatgcccggtgggtgattccatagagtccgccacgtggttctggcctagctggcaggtgattttggtgtgtctggcaggggcttccggcgagtcgagcaggtggctccggcgtgctcggcaggtgattcaggcgtgtccggtaggtgcttccattctgtccggtaggtggttccggcgtgtccggcacatgtttctggcacgtctgagaggtggttccagcatgcccagcaggtgatcccggagagtcctccaagtggttatggcgtacacggcaggtgattttggtgtgtccagcagatggttctgtagagtcgagcaggtggttctggtgtgctcggcaggtggttcaggcgtgtccggcaggtggttccagtctgtccactatgtggttccggcgtttccggcacgtggttctggtacttctgagaggtgtttcctgcatgccctgcaggtgattccagaaagtctgctaagtggtactggcgtagctggcatgtgatttgggcgtgtccggcaggtgcttccagcgagtcgagcaagtggatccggtgtgctgggcaggtgctcccagtatcattggcatgtggtgtcggcgtgtctgagaggtggttccggcatgcccggcaggtgattccggagtgtccaccaattggttctggcgtagctggcaggtgatattgcatgtccggtggtggttccggcaagtcgagccggtagttccggggtgtccggcatgtgcttctggcatgtctgagatgttgtgccggcatacccataacgttattccggcatgtacgccaagtggctctggcgtagccggcaggtgattttcacgtgttcggcagatgggtccagcgagtaaagcagctggttctggtgagctcggcaggtgcttcctgagtctctggcatgtggttgtggcacatctgagaggtggttctcgcatccccggcaggtgattacggagtgtccgccatgtggttctggagtagccgacaggtgattttggcatgtctgtcaggtggttctggggagtggatcacgtggttctggcatactcagcaggtggttccggcatgtctggcatgtgtttctggcacgtctgagaggtggttccagcatgcccggcagttgttcccagagagtcctccaagtggttctggcgtagcccgcaggtgattttggtgtgtccggcaggtggtcctggcgagtcgagcaggtggttccagcgttttcagcaggtggttcaggcatgtctggcatatggtgacgatctgtccgggaggtggttgcggcgtgtctggcacgtgattaaggcatgtatgagaggtggttccggcatgcctggcaggtgatcccggagattcctccaagtggttgtgacgaagccggcaggtgaatttcgcatgtccagcaggtggttctggcaagtctagcaggtggttccggcgagctgggctggtggtccaggtgtgtccggcagattgttcccgtctgtccaggaggtggttcctgtctgtccgggatgaggttgtggcatgcttggcaggtgcttcctgcgtaatcggcgtgtgcttctagcacatctgagatgtggttctggcatgcccagcaggtgattccagactgttcaccagatggttctggcacatctgagaggtggttccggcatgcccgtcaggtcttcctggagattcctccaagtggttctggcatagccgtcaggtgattttggcgtgtcctgtaggtggttccggcgtgctcgtcaggtggttcagacaggtctggcaggtggttccggtctgtccgggaggtggttccggcatgtccggcacgtggttccggcacgtctgagagatggttctggcatgcccgactgatgattccggattgtccactaactggttctgctgtagccggcaggtgattttgacgtgtccggcaggttgttccagcatgttgagcaggtggttccggcgagctcggcaggtgcttccggcgtctccggcacgtggttccggcacatctgagaggtggttccagcatgcccggtaggtgattcccgagtgtccgacaagtggttctggcatagcctgctggtgattttggcgtgtccagcaggtggttctggcgagttgagcaggtgttttcggcatgctctgcaggtgcttccggcgtctccagagtgtgtttctggcgcgtcagagaggtggttccgacatgcctggcaggtgatcctggagattcctccaagtggttgtggcatagccagcatgtgattttggcgtgtctggcagctgcatccagcgtgtcgagcagatggctccggtgtgctgggcaggtgctaccggtatctttggcacgtggtgctggcatgtctgagagctggttcctgcatgtccggcaggtgattccggagtgtccaacaagtggttctggcatagccggcaggtgattttggcgtgtccggcagtggttccggcgagtcgagcaggtggttccggcgtgctcggcaggtggttccggtcggtcctggaggtggtttcggtctgttcagcatgtggttctggcatctctgagaggtggttccggcatgcccggcaggtgatcccagagagtcctccaagtggttctggtgtagcccgcaggtgatctttgcatgtccggcaggtggttccggcgtgctcgtcaggtggttcaggcaggttcggcaggtggttctggtctgtccaggagatggttccaacgtgtaaggcacgtggttccggcacgtatgagaggtggttctggcatgcccgcaggtgattctagagtgtccgaaagtggttctggcatagtcggcaggtgattttggcgtgtcctgcaggtggctcccctgagttgagcaggtggttccggcctgcttggcaggtggttccggcgtgtctgggtggtggttctggtctgtccggtaggtggttccggcacgtccggcatgtggttctggcattctgtgaggtggtttgagcatgcccggcaggtgattcctgggtgtcccccaagtggttctggcatcaccggcagattattttggaatgtccggcaggtctttcctgcttttttggctcgtggctctggcttgtaagacaggtgtttgtggcatttctggcccccggttctgacataatccacagtggctttcagtgtttctggcacctgtttgtggcatatccaacaggtgtttccaatgtgtctggtatgtggttgtgctacgtttggaatctggttccgtcatgtctgttgtgtgcatctggcatgttgaagagatggttctgcagtgtcagaatcgttgttccactgtgtccggcaggtggttacaggtggagctggcatgcaacgtgggtgcttctggtgtgcctgttgtgacgttctggcatgaaggtgtggttctctaagagtgtgcgagaggctgtttttggcatgtctcctggtctaagtggcatgattcctttctatacgtcaggcatgtttgttctcagcttcctaaatagatgaaagaaagatggtctgtggcttgttgccccttgaggggtggagcgagtgcattgtgcagtccacgtctagagcaatggagggcacggctgagagcaaagggacctttctgacataggtcttttctgacactctctccaccagtgcacaatggggatgtgtaaaaagcctattgtctctctcctcttaagcatgtggaagcacagtcatatgggcctcctccccgttgctgaaggggacgatgtaggcatttcgtcagagcccggttggcaaggtggaaatgtggcagaaacagaagttccaaattggcgagttgagggctgaaaagaaacggcatatcagctgcctttgtatgagaagttccctggacgctgtaagatcactcttgaaagaaagttccttctcttcttcctaaagagatggaagctaggtagtctgtggattgtcgccccttgaggggtggagcaagagcattgtgtattccacgtctagagcaatggagggcacgactgagaacaaaggggtctttctgacatagctgctttctgacactctctccatcagtgcacaatggtggttggaaaaaggcatgcagtctatcgcctcctaagcacgtggacgctcaatcatttgggactcagcccagttgcttaaggcaaagatgtaggcatttcgtctgagccgggttggcaaggtggaaatgtgcaggatgcagatgttccagactggcgagtgaagtgctgaaaagaaacagcgttcagcctcctttgtatgagatgttcccagcaccttgtaagagcactgtggaaagggtattttttctcagcttcctaaagagctggaagcaggacaagatgtggtttgtctcccattgaggggtggatccagagccagtgccttgtgccttccacctctagagcaatggaggccgcggctgagagcaaatgggcctttctgacatagctgctttctgacactctctccaccattgcgcaacagtggtttgtaaaaagcgtattgtctatctcctcctaagcaggtggactctcagtcctttgggactcagccctgttgcttcaggggaagatgtaggcatttcatctgagccctgttggcaagttggaattgtggcagaagcagaagttctaaagtggcaagttaagggctggcaagaaaagccctttgaccagcatttctatgacagtttcccggtaggtggttcctgggagtcgagcaggtgtttccagcatgctcggcaggtggttcttgtctgtgatggaagtggtccagggcgtccagcacgtggttctggcacatctgagctgcagtttcggcatgcccggcaggttattctggagtgtcggccaagtggttctggcatagccggcaggtgattttggcatatccagcaggtggttccagcaagtcgagcaggtgtttccggcgtgctcataaggtggttcaggcgtgtccggatggtggttccagtctgtccgggaggtggttccggcgtgtctggcacgtttttcaggcacgtctgagaggtggttctggcatgcccgacaggtgattccggagtgtccgccaagtggttctggtgtagctggcaggtgattttggagtgtccggcaggtggttccggcatgctcagcaggtggttcaggtaggtccagcagatggttccggtctgcccgggaggttgttccggcatgtccagcacgtggttctggcacgtctgagaggtggttctgcaacgcccggcaggtgattctggattgtccactaactggttctggtgtagccggaaggtgattttgacatgtccggcacgtggatccggcatgtcgaggaggtggttccggcgagctaggcaggtgatcccagcctctccggcacgtggttctggcacttttgacaggtggttccggcatgcccgggaggtgattcccgagtgtctggcaagtgtttctggcatagccggtaggtgattttggcatgtccggcatgtgggtcctgcgagttgagcaggtggttccggcatgcttggcaggaggttcaggcgcatccatcatgtggttccgttctgtccggtaggtgcttccggcgtctccggcacgtggttctgacacatctgagaggtggttccagcatgcccggcaggtggttccggagtgtccgacaagtggttctggcatagctggctggtgattttggcgtgtccggcaggtggttctggtgagtcaagcatgtggttacgacgtgctcatcaggtggttcaggcgggtccagcaagtagttccggtctgtccaggatgtgtttccggcatgtcaggcacatggttctggcacgtttgagatgtggttcctgcattcccgccaggtgttcccggagttctgacaagtggttctggcatagccggcaagtgattttggcatgtccggtatgtggtcctggcgggtcgagcaggtggttctgccgtgctcagcaggtggttcaggtgggtcgggcaggtggttccggtctgtccgggaggtggttgcggcgtgtccggcacgaggttcctgaacgtctgagaggtatttccagcctgcctggcaggtgattccagagagtccctcaagtggttctggtgtagctggcatgtgatttggacgtgtccagcagttgcttccagcgactcgagcaggtggctctggtgtgctgggcaggtgctcccggtgtttttggcacgtgtttctggcatgtctgagaggtggttccagcatgcccagcaggtgtttctggagtgtccgccaagtgattctggcgtagctggcaggtgattttgcttgtccggtggtggttctggtgagtcgagcaggtggttccggcgtgcttggcaggtggttcaggcgtgtccggcagttggttccagtctgtccaggacgtggttctggcgtatccggcacatggttctgctacgtctgagaggtgggtccggcatgcccagcaggtgattccggagtttccgccaagtagttctggcgtagccggcaggtgattttggcctgtctggaaggtggttcttgggagtggatcaggtggttcaggcatgctcggcaggtgcttccggcgtctctggcatgtggttctggcgcgtctgagaggtggttccggcatggcctgcaggtgattctggagtgtccgccaagtgattctggcatagccggcaggtgattttgcatgtctggcagtggttccggcgagtcgagcacgtggtttcggcgtgtccggcaggtggttctggtctgtcctggaggtggttccggtgtgtccggcacgtgcttctttctggcacgtctgagaggttgtgctggcatgcccggaacgttattccggcttgtacgccaagtggttccggcgtagagggcaggtgattttggtgtgtccggcaggtgggtctagcgagtcaagcaggtagttccggcgagtctggcaggtggttctggtctttccgggagttgggtccggcgtgtccatcatgtgcttctggcacctctgagaggtggttccagcgtccacggcaggtgattccgcagtatctgccaagtggttctggcgtagctggcaggtgattttgcctgtccggcagtggatccagcgattcgagcaggtggttccagcgtgtccggcaggtggttctggtctgtcctggaggtggtgctgatgtgtctagcatgtgcttctggcacgtctgagaggttgtgtcggcatgcccggaacattattccggcttgtacgccaagtggttctctcgtagccggcaggtgattttcatgtgtctggcaggtgggtcccccaagtcaagcaggtagttatgacgaggctggaaggtggttccggtctttctgggaggtggttccggcgtgtccggcacgtgatcctggcatgtcttagaggtggttccggcattcacggcgggtgataccagattgtccattaagtggttctggagtagccggcagctgatttcggtgtgtctggcaggtggttatggggagtggatcaggtggttccagcatactcggcagttggttccagcgtgtccggcacatggttctggcacgtctgagaggtggttccggcatgcccggcagatgatcccggagagtcccccaagtggttccggcgtagcctgtaggtgatttttgcgtgtctggcaggtggttccggtgagacaagcaggtggttctggcgtgtgctgcagggggttccgttctgtcatgaaagtggttctggcgggccagcaggtgatcttggcatttccggcaggtggttctggcgagtcgagcaggtggttccagcatgctcggcatatggttccggtctgtcctgtaggtggctttggcgtgtccggcacattgttctggtacgtctgagacgtggttccggcatgccctgcaggtgattccggactgtccaccacgtggttctggaatagctggcaggtgattttggtgtgacctgcaggtggttccggcaagtcgagcaggtggttccggcgtgcttggcaggtgcttcaggtgtctccggcatgtgcttctagcacatctgagaggtggttccggcatgcctggcgggtgattccacggtgtccagcaagtggttctggtgtagccggtaggggattttggcatgtgaggctggtggttccagcgagtcgagcaggtggtccggtgtgctcggcatgtgcttctggtctgttcaagatgtggtgccggcgtgtcaggcatgtggttgtggcacgtttaagaggtggttcctgcatgcccgcaggtgattctagagtgtccaccaagtggttctggcttagccggcaggtgattttggcttgtccggcaggtggttccaccaagttgagcaggtggttccggcgtgctcggcaggtggttccagcgtgtctggctggtggttctggtctgtccgggaggtggttccggcatgtccggcacgtggttctggcacatctgcgaggtggttcgggcatgcccggcaagtgattcctgggtgtctgccaagtggttctatcatcaccggcaggttattttggcgtgtccggagggtctttcctgctttttgggctcgtggctctggcttgtaagacaggtgtttgtggcatttctgggccccggttctgacataatccacaggtggtttcagtgtttctggcacctatttgtggcatatctaacaggtgtttccaaagtgtctggcatgtggttgtgctacgtttggaatctggttccgtcgtgtctgttgcatgcgtctggcatgttgaagagatggttctgcagtgtcagaatcgttgttccactgtgtccggcaggtggttcctggtggttctggcatgcaacgtgggcgcttctgatgtgcctgttgtgtccttctggcatgaatgtgtggttctttgagagtgtgtggagggcgtttttggcatgtgtcccagggttttctggcatctaaggggcatgattcgtttctatacgtcaggtgagtttgttctcacatcctaaatagatggaagaaatatggtctgtggcttgtcgccccttgaggtgtggagccaatgcatggtgcattccacgtctagagcaatggagggcaaggctgagaggaaagggacctttctgaaataggtgctttccgacactctctccaccagtgctcaactgtggttggtgaaaagcatattgtctatctcctgctaagcacatggtcacacaatcatttgggactcagcccagttgcttaaggggaagatgtaggcattttgtctgagctggttttgcaaggtggaattgcggcagaagcagaaattctatagctgtgaattaagggctgggaagaaatgccatttgagctgcctttgtatgagaagttcctggtatgctgtaacaggactgtggaaagcgagttgtttgtcagcttcctaaagagctggaggcaagacagtttatggcttgtctcccattgaaggatggaggcagtgctttgtgccttccacctctagagcaatggagggcacggctgagagtaaagggggttttctgaaattggtgctttctgacactctcccaaccattgcacaagggtggttagttaatagcctattgtctctctcctcctaagcaggtggaaccacaatcattcaggcctcatccccattgcttaaggggaagttgtaggcatttcgtctgagccaggttgacaaggtggaaatgtggcacatgcagatgttccagatcggtgagtgaagtgctggaagaaacggtgttcagctgcctttgtatgagatgttccctggacgctctaagagcactgtgacatgcgagctctttctcagcatcctaaagagctggacgcaagaaggtttgtggttcgtctgccattgaggggtggagccagagccagtgcattgtgccttcctcctctagagcaattcagggcacggcttagatcaaagggacctttctgacataggtgttttctgacactttctccaccagtgcacaatggtggtgtgtaaaaagcctatgatctctctcctcttatgcatgtggaagcacattcatatgggccacgtccacattgctgaaggggaagatgtaggcatgttgtcggagcctggttggcaaggtggaaatgtggcagaaacagaagttccaaatcagcgagttaagggctgaaaagaaacggcgtttcagctgcctttgtatgagatgttccatggacgctgtaagatcactggtgaaagcgagttccttctcagcttcctaaagagatggaagcaaggtggtctgtggcttgtcgccccttgaggggtggagccagtgcattgtgcattccacgtctagagcaatggagggcacggctgagagcaaaggggtctttttgacatacttctttccgacactctccccagcagtgcacaatggtggttggaaaaaggcatgcagtctatcgcctcctaagcacgtggacactcaatcatttgggacccagcccagttgcttaaggggaagatgtacgcatttcgtctgagccgggttggcaaggtggaatagcagcagaagcagaagtcttaaagctgcgagttacgggttgggaaaatatgccgtttgtgcagcctttgtatgagaggttcctggtatgctgtaacaggactgtggaaagcgagttgtttgtcagcttcctaaagagctggaggcaagacagtttatggcttgtctcccattgaaggatggaggcagtgctttgtgacttccacctgcagagcaatggagggcacgggtaagagcaaagggggctttctgccataggagctttctaatccccttcaggggtggtgccagtgccttgtgcctcctacctctagaggaatggagggcatggccgagagtaaagggcctttctgacattggtgctttctgacactcccccaaccattgctcaagggcagttggttaaaagccaattgtctgtctcctcctcagcatgtggaaccacaatcatctgggccttgtccccattgctcaaggggaagatgtaggcatttcgtctgagccgggttggcaaggtggaaatgtgcaggatgcagatgttccagactggcgagtgaagtgctgaaaagaaacagagttcagcctcctttgtatgagatgttcccagcaccttgtaagagtactgtggaaagggagttttttctcagcttcctaaagagctggaagcaggacaagatgtggtttgtctcccattgaggggtggatccagagccagtgccttgtgccttccacctctagagcaatggagggtgcggctgagagcaaatgggcctttctgacatagctgctttccgacactctctccaccagtacgcaacggtggtttgtaaaaagcataatgtctatctcctcctaagtatgtggactctcagtcctttgggactcagccctgttgcttcaggggaagatgtaggcatttcgtctcagccgggttggcaaggtggaattgtggcagaagcagaagttctaaagtggcgagttaagggctggcaagaaaggccgtttgaccagcatttctatgacagtttccccgtaggtggttcctgggagtcgagcaggtgtttctggcatgcttggcaggtgcagaaggcgcctccagcaggtggttctggtctgtgacggaagtggtccagggcgtccagcatgtgtttctggcacatccgagctgcggttccggcatgcccgggaggttattctggagtgtcggccaagtggttctggcatagcccgcaggtgattttagcgtatccagcaggtggttccagcaagtccagcatgtggttccggtgtgctcgtaaggtggttcaggcgtgtccggaaggtggttccagtctgtcggggaggtggttctggcttgtccggcacgtttttcaggcacgtctgaaaggtggttctggcatgcccgacaggtgattctggagtgtccgccaagtggttctggtgtagccggcaggtgattttggcatgtccgccaggtggttccggcatgtcgagcaggtggttgcggcaagatcagcaggtgattccggcgtctccggcatatggttctggagtagccggcaggtgattttggcctttccggcaggtggttctgggaagtggatcaggtacttccggcatgcctggcaggtgcttctgacgtctccggcatgtgcttctgggacatctgcgaggtggttctggcatgcccggcaggtggttcaggcatgtccggcaggtgtttccagtctgtcaaggatgtggttctggcatgcccagcaggtgattccggactgtcctccccgtgctctggcatagccggcaggtgattttggcgtgtctggcaggtggttctggggagtggatcaggtggttccggcatactcagcaggtggttccagcgtgtccggcacatggttctggtacgtctgagaggtttttccggcatgcccagtaggtgaccccagactgcccgccacgtggttctggcatacctggcaggtgattttggtgtgtctggaaggtggttacagcgagacgagcaggctgttccagcgtctccggcatgtgcttctggcacttctgagaggtggttccggcatgcccggcaggtgatttcagagtgtccgacaattggttctggcgcagccggcaggtgattttggcgtgtctggaaggtgggtcctgcgagtcaagcaggttgttccggtgtgctcggctggtggttcagtgggtccggcaggtggttccggtcttttcaatgtgtggctccggcctctctggcaggtttttctggcacgtctgagaggtgattccggaatgcccggcaggtgattccggattgtccaccaagtggttctggcatagccggcaggtgggttcggcgagtcgaacatgtggttccggcgtgtccggcaggtggttccggtctgtccgtgaggtggttccggctctccggcacgtggttctggcacgtctgagaagtgccagcatgcccagcaggtgattccggactgtccgccacgtggttctggcacatctgaggtggttccggcatgcccggcaggtcatcccatagagtcctcccagtggttctggtgtagccgtcaggtgattttggcatgtccggcaggtggttccggcgtgcttggcaggtggttcaggcaggtccggcagttggttccggtctgtccgggaggtggttctatcatgcccaacaggtgattccaaagagtctgccaagtggttgtggcgtagccggcaggtgattttggtgtgttcggcagatggttctgacgagtagagcaggtcgttccggcgtgctccacaggtgcttccggcgtctccggcacgtgtttcaggtacgtctgagaggtggttccggcatgtccgacaggtgattccagagtgtccggcaagtggttctggcttagctggcaggtgattttggcatgtccggcaggtgattttggcgtgtctggcacttgttctggtgagtcaagcaggtgtctccggcgtgctcggcaggtggttccagcatgtccagcaggtggttccagtctgtccagtaggtggttctggcatgtctggcacgtggttctggtacctctgagaggtggttccagcatgcccagcaggtgattccggactgtccgccacgtggttctggcacgtctgagaggtggttccggcatgccaggcatgtcttcccagagagtcctccaagtggttctggcgtagcccacaggtgactttgaggtgtccggcaggtggttccggcgtgcttggcaggtggttcaggcaggtccagtaggtggttcctgtctgtccgggaggtggttccagcgtgtccggcacgtggttcctgcatgtcttacaggtggttctggcatgcctggcaggtgattccggattgtccaccaagtggttctggtgtagctggcaggtgatattggtgtgtccagcaggtggttccggccgtcagtcaggtggctctggcgtgcgggacaggtggttccggagtgtccggccggtggttacagtctgtccagtaggtggttccggcgtgtccagcacatggttctggtacatctgagaggtggttcccacatgaccagcaggtgattccggattgtccgccccgtggttctggcatgtctgagaggtgattccagcatgccaggaaggtgatcccagagagtcctccaagtggttcaggcgtagctggcaggtgattttggtgtgtccggccggtggttccggcgtgcttagcaggtggttcaggcaggtctggtaggtggttccggtgtgtccggcatgtggttctggcacgtctgacaggtggttctgtcatgtccggcaggtgattccagattgtccaccaagtggttctcgcgtagccagcaggtgattttgacgtgtgccagaggtggttccgacgattccagcaggtgcttccggagaactcggcaggtgcttctggcatctccagttcgtgattttgccacgtttgagaggtggttccggcatgcccggcaggtgcttccggagtgtccgacaagcggttctggcatagccggctggtgattatggcgtgtccggcacattgttccagtgagtcgagccggtggttccagcatgctcggcatgtgcttccgttcttttcgggaggtggttccggcatgtcaggcatgtggttgtggcatgtttgagaggtggttcctgcatgcccgcaggtgattctagagtgtccgccaagtggttctggcatagctggcaggtgattttggcgtgtctggcaggtggttccaccaagttgagcaggtggttctggcgtgctcggcaggtggttccagcgtgtctgggagctggttccggtctgtccgggaggtggttccagaatgtccggcacgtggttctggcacatctgcgaggtggttcatgcatgcctggcaggtgattcctgggtgtccaccaagtggttatggtgacaccggcaggttattttggcgtgtctggcatgtctttcctgctttttcggcttgtggctctggcttgtaagacaggtgttggtggcatttctggcccccggttctgacatactccgcaggtggtttcagtgtttctggcacctgtttgaggcatatccaacaggtgtttccaacgtgtctggcatgtggttgtgctatgtttgaaatctggttctgtcgtgtctgttgtgtgcgtctggcatgttgaagagatggttctgctgtgtcagaatcgttgttccactgtgtccggcaggtggttacaggtggttctggcatgcaacgtcggcacttctggtgtgcctgttgggtcgttctggcatgaatgtgtggttctttgagagtgtgtggagggtgtttttggcatgtctcccggggttttctggcatctaaggggcatgattcctttctatacatcagttgagtttgttctcacatcctaaatagatggaagaaatatggtctgtggcttgtcgccccttgaggggtggagccaagacattgtgcattccacgtctagagcaatggagggcaaggctgagagtaaaggggcttttctgaaattggtgctttctgacactctcctaaccattgcagaagggtggttacttaaaagcctattgtctctctcctcctaagcatgtggaacaacaatcatccgggcctcgtccccatttcttaaggggaagttgtaggcattttgtctgagccaggttgacaaggtggaaatgtggcacgtgcagatgttccagattggcgaatgaagtgctttaagaaacggtgttcagctgcctttgtatgagatgttccctggatgctctaagagcgctgtggaacttgagctctttctcagcgtcctaaacagctggacgcaagaaggtttgtggctcatctcccattgaggggtggaggcagagccactgcattgtgccttcctcctctatagcatttcagggaatggctgagatcaaagggacctttctgccataggtgctttctgatacccttcaggggtggtgccagtgccttgtgcctcctacctttagaggaatggagggcatggccgagagtaaagggcctttctgacattggtgctttctgaaactcccccaaccattgctcaagggcggttggttaaaagcctattgtctgtctcctcctcagcatgtggaaccacaatcagccaggcctcatccccattgctcagggggaagatgtaggcatttcatctgagctgggttggcaaggtggaaatgtggcagaagcggatgttgcagattgacgagttaagggctgaaaagacacggggttcagctgcctttctatgagatgttcgcaggacgctgtaagagcactgtggaaagcaagtgctttcccagcttcctaaagagctggaagcaggacagtttatggcttgtctccaatagaaggatggaggcagtgctttgcgccttccacctctagagcaatggagggaacggctgagagcaaagggccttttctgacataggtgtattctgacactctctgcaccagtgcacaatggcggtttgtaaaaagcctattgtctgctcctgctaagcatgtggaagcacaatcatctgggccttgtccccgttgctgaaggggaagatgtaggcatttcatctgagcctggttggcaaggtggaaatctggcagaagcagaagctccaaatcggcaagttaagcactgaaaagaaacggcatatcagctgcctttgtatgagatgttggcaggacacagaaagagcactgttgaaagcgagttctttctcagcttcctaaacagatggaaggaagatggtctgtggcttgttgccccttgaggggtgaaacaagtgtattgtgcattccacgtctagagcaatggagggcacgggtgagagcaaagggctctttctgacatagctgctttccgaccctctctccaccagtgcacaatggtggttggaaaaaggcgtgcagtctatcgcctcctaagcacgtgggcactcaatcatttgggactcagcccagttgcttaaggggaagatgtacgcatttcgtctgagccaggttggcaaggtggaattgcggcagaagcagaagtcctcaagctgcgagttaagggctgggaaaaaatgccgtgtgagctgcccttgtatgagaggttcctggtatgctgtaacaggactgtggaaagcgagttgtttgtcagcttcctaaagagctggaggcaagacagtttatggcttgtctcccattgaaggatggaggcagtgctttgtgccttccacctctagatcaatggagggcacagctgagagcaaagggggctttctgcaataggtgtgttctgatccccttcaggggtggtgccagtgccttgtgcctcctacctctagaggaatggaggtcgcggccgagagtaaagggcctttctgacattggtgctttctgacactcccccaaccatagctcaagggcggtttcctaaatgactattgtctgtctcctcctcagcatgtggaaccacaatcatccgggcctcgtccccattgctcaaagggaagatgtaggcatttcgtctcagctgggttggcaaggtggaattgtggcagaagcagaagttctaaagtggcgagttaagggctggcaagaaaggccgtttgacctgcatttctatgacagtttccccgtaggtggttcctgggagtcaagcaggtgtttctggcctgctcggcaggtgcagaaggcgcgtccggcaggtggttccgggctttcacagaagtggtccggggcattcagcatgtggttctggcacacccgagggttggttccggcatgcacggcatgttattctggagtgtcagccaagtggttcttgcgttgctggcacgtgattttggcgtatccaggaggtgggtccagcgagtcgagcaggtttttccagtgtgctcgtaaggtggttcaggcgtgtcctgcaggtggttcttgtctgtccggtaggtggttccggggtgtcctgcatctggttccagcgagtcgaacaggtggttccggcgagctcggcaggtggttccagcgagctcggcaggtgcttccggcgagctcgacaggtgcttccggcgtctctggcacgtggttctggcacttttgagagtggttccggcatgcccggcaggtgattccggactgtctgccacgtggtcctggcatagccggcaggtgattttggcgtgtccagcatatggttctggcgagtcgagcaggtggttccggtctgtccggtaggtggttccggcgtgtccagcacgtggttctggcacatctgagaggtggttccggcatgcccggcaggtcattccggagtgtccgccaagtggttctggcatagtcagcaggtgatttcagagtgtttggcaggtggttctggggagtggattagttggttccagcatacttggcaggaggttccgtcgtgtacggcacatggttctagcacgtctgagaggtgtttctggcatgcccagcaggtgattccagagagttcgccaagtggtcttggcatagcctgcaggtgatttgggtgtgtccggcatttgcttctggcgagtcaagcaggtagttccggcatgctgggaaggtgcttctggtgtctttggcacgtggttctggcatgtatgagaggtggttccggcatgcccagcaggtgattccggagtggccgccaagtggttctggcttaaccggcaggtgattttgcgtgtctgtcggtggttccggcgagtcgagcaggtggttccagcatgtccggctggtggttccgctgtgtcctggaggtggttccggcgtgttcgtcacgtgcttctggcacgtctgaggtgttgtgctggcatgcccggaacgttattcccgtttgttcgccaagcggttctgcgtagctggcaggtgattttggtgtgtccaacagatgtgtccagtgaatcaagcaggtggttccggcgagtctagcaggtggttcccatctttaagggtggtggttccggcgtgtccggcacgtgcttctggcacgtctgacaggttgtgccagcatgcccggcaggtgattccagagtgtctgccaagtggttctgacatagcccgcaggtggttccggcgtgctcggcatgtggttcatgcgtgtctggcaggtggttccggtctgtctgggaggagtttccagagtgtctggcacgtgtttctggcacttctgagaagtggttctggcatgcccggcaagtgattcctgaatgttcgccacgtggttctggtgtagctggcaggtgattttggcgtgttcggcaggtggttccagcgagtcgagcaggttgttctggcgtgctcagcaggtggttcagacgtgtccggtaggtggttgcagtctgtctgggaggtgcttccagggtgtccggcacgtggttctggcacatctgagaggtggttctggcatgcctgacatatgattctggagtttccgccgagtggttctgccttagccggcttgtgattttggcgcgtacagcagatagttccagcgattcaagcaggtggttctggactgttcagcaggtggttcagacgtgtccgacaggtggttccggtctgtctgggaggtggttccagcgtgtcaggcacgtggttctggtacgtgtaaacgggtttccggcaggcccgacaggtgattccggagtgtctgccaagtggttctggcgtagcctgcagttgatttgtgcatgtccggcaggtggttctggggagtggttcgtgtggttctggcatactcggcaggtggttcctgcgtgtccagcacatggttctggcacgcctgagaggtggttccggcatgcctggcaggtgatcccggagagtcctccaagtggttctggcgtagccagctggtgattttggcatgccagagaggtggtcccggcgagttgagcaggtggttctggcgtgctcggcatgtggttcaggtgggtctgacaggtggttccagttggtccaggtggtggttccggcgtgtgcggcacatggttctggcacgtatgagaggtggttccagcatgcctggcaggtgatcctggagagtcctccaagtggttctggcgtagccagcaggtgattttggcttgtcaggaaggtggttctggccagtcgagcaactggttctggcatgctcggcaggtggttctggcgggtccggcatgttgttctggcctgtccaggaggtggttctggcgtgtctggcatatggttccagcacatctgccaggtggttccggcatgccaggcaggtgattccagagagtccgccaagtggttctggcgtccagcaggtgattttggcgtgtgctgcaggttcttctggcgagtcgagcaggtggttccggtgagctcggcaggtgcttccggcgtctccggcacgtggtactggcacttctgtgaggtggtaccggcatgcctggcaggtgattgcggagtgtccgacaagtggtggtggcatagccggcatgtgattttggcgtgtccggtatttgggtcccacgagtcaagcaggtggttccattgtgctcggcaggcggttcaggcacgtccggcaggtagttccgttctgtccagtaggtggttccggcttgtccgacacgtggttctggcacgtctgagaggtggttccagcatttccggcaggtgattctggagtgtccgccaattggttctggcgtaccgggcaggtgattttggcatgtacggcaggtggttctgtggagtggatcaggtacttccggcattttcggcaggtgcttcctgcgtctccagcttgtggttctgtcacatctgagaggtggttatgtcatgccccgcaggtgattccggaatgtccggcaagtggttctggcacagtggtaggtgattttggcgtgtccggcaggtgggtcctgggattcgagcaggtggttccagcgtgctaggcaggtgcttccagcgactgcagcacgtgtttctggcatgtctgagaggtggttccggcatgcccggcaggtgattctggagtgtccgccaagtggttctggcatagctgactgatgattttggcatgtccagcacgtggttccggcgactagagcaggtggctccggcatgctcggcgggtgattttggcgtgtccatcagatgattctgtgcagtggatcagttacttgcggcattctcggcaggtgcttcctgtgtctccggcatgcggttgctgcacgtctgagtggtggttccagcatacccggcaggtgattctggaatgtccgccaagaggtactggcgtagccggcatgtgatttgggcatgtccgacaggtgcttccagcgagtcgagcaggtggtgccagcatgctcggcaggtgctcccggtgtcttttgcatgtggttctggcatgtctgacaggtggttctggcatgcccggcaggtgattccggtgtgtccgccaagtggttctggcgtagccggccaggtgattttgcgtgtccggcggtgcgtctggcgagtcgagcagggggttcccgcgtgtcccggcaggtgttttctgatctgtccgggaggtggttccggcatttccagcacgtgcttctggcacgtcttagaggtgatttccggcatgcccggcaggtgattctggattgtccaccaagtggttctggcgtgagccggcaggctcttttggtgtgtccagcaggtggttccagcatttcgagcaggtggttctggcaagctcggcagatgcttccggcgtgtccagcatgtggttctggcaggtttgagaggtggttccggcatgcccggcaggtgattccggagtgtctggcaagtggttcaagcatagctggcaggtgattttggcgtgtccggcaggtgggtcctgcaagtcgagcaggttgttccgttgtgcttggcaggaggttcaggcgtgtctggcaggtggttccagtctgtccaggacgtggttccggcatgtctggcaagtggttttggtacatctgagaggtgtttccggcatgtacggcaggtcttcccggagagtcctccaagtggttctggggtagctgtcaggtgattttgtcatgtccggcaggtggttccggcttgctcggaaggtggttcaggcaggtcctgcaggtggttccaatttgtccgggaggtgcttccggcgtctccggcacgtgtttctggcatgtcggagaggtggttccggcattaccggcaggtggttcaggcgtgtccagcagatgtttccagtctgtccagtatgtggttccggcatgcacagcaggtgaatccggagtctccgccaagtggttctggcgtacctggcaggtgattttggtgtgtccggcaggtgtttctggcgagtggatcaggtggctctggcatgctcggcaggtgcttccggcctctctgtcacgttgttctggtgtgtcggacagctggttcgggcatgtctgacagatgattccggattgtccaccaagtggttctggcatacctggcaggtgactttggcaagtctggtaggtggttccagtgagccgagcaggtggttctgacatgctcggcaggtgcttccggtgtcattggcatgtggttctggcatgtctgagaggtggttccggcatgcccggcagatgattccggagtgtttgccaagtggttctggtgtggccggcaggtgatttcgcatgtccagcggtggttccggcgagtccggcaggtggttctggtctgtccagcacctggttctggggtgtccgggacaaatttctggcacgtctgagaggttgtgctggcatgcccttcacatgattctggcttgtccgccaagtggttctggtgtagcgggcaggtgattttggcgtgtccggctggtgtgactggtgagtcaagcaggtggttccagcgagtctttcctgtggttctgctctgtccgggagatggttccggcctgtccggcacgtgcttctggcacttctgagaggttgtgctggcatgcccggcaggtgattccggagtgtccgccaagtggttctggcatagatggcaggtgattttgccgtgtccggcatgttgttccagtgaggcgagcatgtggttccggcgtgctcggcagatggttcaggtatgtccggcaggtggttccggactgtccgggaggtggttcgggcatgtcgggcacgtggttccggcacgtctgagaggtggttccagcatggccggcaggtgattccagagagtccgccaagtggttctggcctagccgtctgatgattttggtgtgtccactaggtggttctggcgagtcaagcaggtggttccggtgagctcggcacttgcttccagcgtctctggaattggttctggcacgtctgagaggtggttcctgaatacccagctagtgattcaacagtgtccggcaagtggttctggcataagcggcaggtgaatttggcatgtcctacaggttcatcctgggagttgagcaggtggttccggcttgttcgacaggtggttcaggcatgtccggcaggtggttcatgtcggtgcaggccgtggttccgtcgtgtccggcacgtggtttcagtacatctgagaggtggttctggcatgcccggcaggagattccggagtgtccggcaagtggttctggcacttctgagaagtggttctggcatgcccggcaggtgattccagaatgtctgccacgtggttctggcgtagccggcaggtgattttggggtgtcaggcaggtggttctggcaagttgagcaggtggtaccggcgtgcttggcagggggttcagacgtgtccggtaggtggttgcagtctgtccgggaggtgcttccaggatgtccagcatgtggttctggtgcgaatgagaggtgcttccagcatgcctggcaggtgattccagagtgtccgccgaatgcttccggcttagccggttggtgattttggcgtgtctggcagatggttccggcgagtggagcaggtggttctggagtgctcggcaggtggttcagacgtgtccaacaggtggttccggtctgtacggaaggtggttccagcgtctccggcacgtggttctggcaggtttgagaggtggttctggcatgcccggcaggtgattctggagtgtccagcaagtggttctgacatagccggcgtctgattttgacgtgtctggcaggtgggtcctgtgagtcgagaaggtggttccggcatgctcggcaggtggttcaggcgggtccggcagatggttccggtctgtccgggaggaggttcaggcgtgtccggcacttgcttccggcacgtctgagaggtggttccggcatgcccgccaggtgattccggattgttcaccaagtggtcctggtgtagccggcaggtcactttggcgtgtccagcaggtggcaccggcgagtcacgcatgtcgtttgagtgagctcggcaggtgcttccggagtctccggcacgtggttctggcacgtctgagaggtggttctgacatgcccagcctgtgattccggattgtccactaagtggttctggagtagccggcaggtgattttggcgtgtccagcaggtggttctggcatgttgagaaggtggttccggcgagctcggcaggtgcttccagcgactccagcatgtgtttctagcacgtctgagaggtggttctggcatgcccggcaggtgattccagagtgtccggcaagcggttttggcacagccggcatgtgattttggcatgtccggtaagtgggtcctgcgagctgagtaggtggttcctgcgtgctcggcaggtggttcaggcgtgtccggcaggtggttccagtctgtccaggacgtagttccggcgtgtctggcacgtggttctggtaagtctcagaggtggttccggcatgcccggcaggtgatccaggagactccactaagtgattctcacgtagccggcaggtaattttggcatgtccggtaggaggtcgcagcatgctctgcaggtggttcaggcaggtccggcaggtggttccggtctgtccaggaggtgcttccggcgtgtccagcacttggttccggcacgtctgagagatggttccggcatgcccgccaggtgatttcggattgtccaccaagtggttctcgtgtagccggcagatcactttggcgtgtccggcaggtggctccggcaagtcgagcatgtggtttgagcgagcttgacaggtgcttccggtgtctctggcacgtggttctggcacatctgagaggtggttctgacatgcccggcacgtgattccggattgtccactaagtggttctggcgtagccggcaggtgattttggcatgtccagcaggttgttccggcgagtcgagcaggttgttccggcgtgctcggcatgtgcttctgacgtctccggcaggacgttgtggcacttctgagaggaggttctggcatgcccggcaaatgatttcgtaatgtctggcaagtggacctggcatgccagcgggtgatcttggtgtgtccagcaggaggttccggcgagtcgagcaggtggttccagcatgctcggcatatggttctggtctgtcctgtaggtggttctggcatatcgagcaggtggttccggcgtgctcggcagggggttcagacgtgtccggtaggtggttgcagtctgtccgggaggtgcttccagggggtccagcacgtggttctggcacgtctgagaggtggttccttcatgcctggcaggtgattccggagtgtctgccgagtggttctggcttagccggctggtgattctggcatgtccagcagatggttccggcgagtcgagcaggcagttctggagtgctcggcaggtggtccagacgtgtccgacaggtggttccggtctatccgggatgtggctctggcgtgtccggcacgtggttctggcacatctaaagggttttctggcaggcccgacatgtgattccagagtgtctgccaagtggttctggcgtggccggcaggtgattcgagagtgtccgccaagtggttctgacatagcctgcatgtggttcctgcagtgctcagcaggtggttcaggcgtgtccggcaggtggt

SEQ ID NO: 74 - DNA, 30666 bp, Equus caballus
agtggatgcagtgatcctgcagtgattgcagtgtgcctgcatttcctcatcagctggaagcagtgttgcggcagtggttgcagtgccaactaatgtgtccctgaaggtgaatgcagtgcccatgtagttgaggcagtgtacctaaaggtttatgcagtatgttgtgacggcaggatgtattgtgcatgaaggcggatgcagtgtctgtgcagtggttgcatggccccagtattgtgctggaatgtggattcaggggtcatgcagtggctgcagtgtctcataaggcagattcagtatgttttgtcggaggatgcagtgcccatgaaggtggatgcggtgaacttgcagtggttgcagtgccccctactgtttccctgaatgtggatgcagtgaacatgcagtgcatgcagtgtcccaaaaggtggataccgtatgctgtgtcggaagatgcagtgcccatgaaggtggatgcagtgagcctgaagtgattgcagtgcacttgcacggccacttcagctggatgcagtgttgctgcagtggttgcagagccaactgcagtgtccctgaatgtggatgccatcgccatgaagtacatgcagtgtcccacaatgtgcatgcagtatgttgtgacggaggatgcagtgcccatgaatgaacatgcagtgatcctttaatcattgcagtgaacttgcagtgccacttcagctggctgcagtgtcctgcagtggttgaagtgccccattctgtgtccctgaatgtggatgcagtgcccatgcagtggatgcagcataccgaaagttggttaccgtatgttgtgacagaggatgcagacccatggagttggatgcaatgagccggcagtgactgcagtacgctttcagtgccacttcagctggatacagtgtccctgcagtagttgcaatgccccctgcattgtcctggaatatggatgcagtgctcatgcagtggatgcactgttccacaatgtggaggcattgtgatgtgttgtagtatgcagtgctgttgaaggtgaatgcagtgatcctgcagtgatggcagtgtgcctgcagtgccacttcatctggatgcagtgttgctgcagtggttgcagtgccccctgcattgtctgggaatgtggatgcagtggccaggcggtggatgcaatgtcccacaaggtggatgcagtatgttatgacggatgatgcagttctcatgaaggtggatgcagtgtccctgcagtgcttgcagtgccccccacattgttcgggaatgtggatgcagtagtcatgcagtcgatgcagtgtcccacaaggtagatggagtgtgttgtgatggtggatgcagggcccatgaaggtggatgcagtgaagctgcagtggttgcagtgccacctacatttctctgaatgttcatgcagttcccatacattagttgcagtgtacctaaaggtttatgcagtatgttgtgatggaggacccagtgcccatgaagggggatgcagtgtccctcctgtggttgcagtgcccaccacattgtcctgaaatgttgatgcagtgcctatgcagtggatgcagtgaaagttcagtgagtgcagtgcacctgcagtgccacttcatctggatgcagtgtagctgcgtggttgcagagccccctgccatgtccctgaatgtggatgccatgcccatgcagtgtcttcagtgtgactcaaggtgaatgccatatgttgtgaactaggattcagtgcccatgaaggaagatgcagagatcctgcaatcattgcagtgcacctgcagtgccactgcatctgtatgcagtgtccctgcagtgattgaagtgcaccctgctgtgtccctgaatgcagatgctgtgaaaatgcagtggatgcagagtcccacaagctggatgttgtatgttgtgatggaagacgcagtgcccatgaagctgcatgcagtgagcatgtgctgaatgcagtgcacctgcagtgtgattcagctgcatgcagtgtcgctgcagtggttgcagtgcccactgcattgtctgagaacatagatgtagtgcccagacattggatgcagtgttccacaaggtgcatgaagtatgttgtgacggatcatgcagtacccatgatggtggatgcagtgatctggcagtttttggactgcacctgcagtgccacttcagctggctgcagtgtccttcagtggttgcagttccagattctgtgtccctgtctgtggacgcagttcccagggtttggatggagtgagccggcagtgattgcagtacgccttcaatgccacttcagctggatgcagtgtcctgcagtggttgcaattccccctgcattgtcctggattgtggatgcagtgctcatgcagtggatgtagtgtcccacaatatagaggaattgtggtgtgttgtagtatgcagtgccgatgaaggtgaatgcactgataatgcagtcatggcagtgcacctgaagagccaattcagctggatgaagtgttgctgctgtggttacagttcccgctgcattggccagatatgtggaggcagtggtcaggcagtggatgcagtgtcccacaaggtggatgcagtaggatatgacggatgatgcaggtcccatgaatgtggatgcagtgatctggcagtggttgcagtgcaccctgctgtgtccctgaatgtggatgcagtgcccatgcagtggatgcagtgtaccacagggtgcatgcagtaagtagtgacggaggatgcagtgcccatgagtgtggatacagttatctggcagtcgttgcagtgtaccatgctgtgtccctgaatgtggatgctgtcaacatgcagtggatgcagagatcaggcagtgattgcagtgcgcctgcatttccacatcagctggatgcagtgtccctgcaggggttgcagtgctgccttctgtgtccctgaaggtgaatgcagatcccatgatgtggaggcagtgtacctaaaggtatatgcagtatgttgtgagggaggttgcagtgcacatgaaggtggatgcagtgttcctgcagtggttgcagggccctctgcagtttacctgaatgtggatgcagtcctcacgcagtggatgcagtgtccctcaaagtggatgccttatgatgtgttggaggattcagtgatcatgaaggaggatgcagtgatccagcagtcattgcagtgaacttgcagtgccacttcagctggccacagtgtccctgcagtggtcacagtgccccgtcctgtgtccctgtatgtggctgcagtgcccatgcagtggatgcagagtaccaaaattttgttgccatatgttgtgacagaggatgcagagccctggatttggatgcagtgagccggcaatgattgcagtacaccttcagtgccaattcagctggatgcagtgtccctgcagtggttgcaatgcccccagcattgtccaggaatgtggatgcagtgctcatgcagtggatgcagtgtcccacaatgtggaggcattgtggtgtgttgtagtatgcagtgccgatgaaggtgaatgcagtgatcctgcattgatggcagtgcaccagcagtgccacttcatctggatgcagtgtccctgcagtggttgcagtgcaccctgctgtgtccctgaatgtggatgctgtgcacatgcagtggatgaagtgatctttcagtgattgcagtgtgcctatggtgccagtacagctggatgcagtgtagctgcagtggttgcagagccacctgccatgtccctgagagtggatgctgtgcccatgctgtgtctgcagtgtgacacaaggtggatgcagtatgttgtgaagtagtgttcagtgccgatgagggacgatgcagtaattctgcagtcattgcagtacacctgcagtgccacttcagctggaagcagtgttgctagagtggttgcagtgccaccttctgtgtccctgaaggtaaatgcagtgcccatgcagtggaggcagtttacctaatcgtttatgcagtatattgtgactgagggtgcagtgtgcatgaaggcgggttcagtgtccctgcagtggttgcagggccgctggcattgtgctggaatgtggatgcagtggtcatgcagtggatgccgtgcctcacaaggcagatgcagtatgttttgtcgtaggatgcagtgcccatgaaggtggatgctgtgaacctgcagtggttgcagtgccccctacagtttccctgaatgtggatgcagtgcccatgcagtgcatgcagtgtcccacaaggtggatgtggtatgctgtgatggaggattcagtggccacgaaggtggatgcagtgatcctgaagtgattgcagtgcacttgcagtgccacttcagctggatgccgtgttgctgcagtcgttgcagagccaactgcagtgtccctgaacctggatgcagtgcccatgcagtggatgcagtgtcccacaatgtgcatgcattatgtcgtgatggagtatgcagtgcgctggagttggatgcagtgatcctgcagtggttgcagtgccccttgcattttagctgaatgtggatgcagtgctcatgcagtggatgcagtgtcccttaaggtggatgccttatgatgtggtggaggattcagtgatcatgaaggaggatgcagtgatccagcagtcattgtagtgaacttgcagtgccagttcagctggatgcagtgtccctgcaatggttgcagtgccccatcctcttccctgaatgtggattcagtgtccatgcagtggatgcagagtacaaaaagttggttgccgtatgttgtgaaagaggatgcagagccctggagttggatgcagtgatccggcagtgattgcagtacgtcttcagtgcccttcagctggaagcagtgtccctgcagtggttgcaatgcccctgcattgtcctggaatgtggatgcagtgctcatgcagtggatgcaatgtcccacaatgtggaggcattgtggtgtgttgtagtatgcagtgccattgaaggtgaatgcagtgatctggctgtgatggcagtgcatctgcagtgcgacttcatctggatgcagtgttgctgcagtggttgcagtgcccctgcattgtcttggaatgtggatgcactggcaagacagtggatgctgtgtcccacaaggtgcatgcagtatgttatgaccgatgatgcatttctcatgaaggtggatgcagtgttcctgcagtgctggcagtgccccactcattgtccgggaatgtggatgcagcagtcaagcagtagatgcagtgtcccacaagctggatgcagtatgttgtgatggaggatgctgtgcccatgaaggtggctgcagtgatgctgccgtggttgcagtgccccctacagttccctgaatgaggatgcagtgcccatgcagtagttcagtgtcccacaaagtggatgtcgtatgttgtgagggaagattcagcctcattgaagcacgtgtcagccacactggcacaacttgcctgccatgcctgaaccacgtgccacccatgacaaaaacacatgtgagccacgcctgaacaacaccacagacatgcatgagccacacctgaaccatgtgtgagccatgcgtgaccaaagcctgtatcatgtgtcagccacatgggagccagttctgtggcacacctgcatcacgtgtgagccatggctgagctatgcctgaaccacgtgtgagagtgtccacaaccatacgtgacccagacgagttgtgtgagatccacgcctgaattacacccgagccatgtgtgagccatgcaagaaccacatgggagacactcttgaaccacatctgaagaacctgtgaaacgcacatgttccatgcttgaaccacgcatgaaccacaggggagccacccatgaaacacagctgagccatgtgtgagccaagtggcagccatgactgagtatgtgggagccacgtttcagcaacctgtagtcatatgggagccacccatgaacggcatgtgactcctgcatgatcacattttgtcacacatggatactgggcaatgaaggccatgcatgaaccatgtgtgaaccacaccagtgtgacctgtcaggcacacctgtgtcatgtttccacctcacttgagtcatgtgtcagccacgcctgaacatgtgtaccacgcctgtgtcaagtctcagccacgccaagtcaagtgccagcccagcaatgtgtgagtcacatgggagccacaagagaacatttcccccatgggtgaagcaggcatatgccacgcatggatactgtgcgatgaaggcctgagtcacttgtcatccacgcctgagacatgtgtcagccacaccatagtcatgtttcacacatgcctggggcacatgtcagccttgcctgaaccaccggccacccatgtgtgaaccgtgaaccagccacgcctgaaacacacgaaggccatgcatgaaccgtgtgtgaaccacacctgcgtgacatgtcaggcactcctgtgtccttcatccacctcacctgtgtcatgtgtcagccttgccagaataacgtgtgagccacgcctgagtcacttatcagccgtgccgatgtcacatgccatccaggcctgaaccaagtgccagtcacacttgaaccacaggtcagcctcacttgaagcacgtttcaccacactggcacaatgtgcctgccatgcctgtcccacgtgcccaccatgagacaaacaaatgtgagccatgcctgagcaacacctcagccatgcatgagccacaccttagccatgtgggagccatgcgtgacaaaagtgtgaatcatgtgtcagccacaggtgaaccagttctgtggcacacctgcatcacttgtgagccatggctgagctaggccggaaccacgtgtgaaagtgtcctctaccatatatgacccacactagttcgtgtgtgagccacacctgaatcacacccgatccatgtgtgagccgtgcatgaaccacatgtgagacacccttgaaccgcatctgaaacacacatgttcgatgcttgaaccacacatgaaccacaggggagccacacatgaaacacagctgagccatgcgtgagccacatgccagccatgactgagtacgtgggagccctgtttcagcaatgtgggagccacacctgtacgacatgtcccacgtgtgaccacattcctgccacacatggataaagtgcaatgaatgcctgagtcctgtgtcagccatgcctgcgtcatgtcctcccagaatcagaaaagtgccagagacacctgaatcacctgtcacccccatctgaaccacgtcatgcacacctgagccatgtgtcaactgtgacacaccaagtgtgagccacacagcaatcatgtgtcactgcagcctgaacgaagcatcacataccactgggacccaagtgcgacacgccttaatcccatgcctgaaacagatgccagcaacgcctgaatctcatgtcagacatgcctgagccacgtggcaaccatgccagagccacgccccagcatggcgtgaccctcacctgacacgtgttagccatgtgtgacaaactcctgaatcatgtgtcagccacacctggccccggtctgaggcttgcctgaactaccggtgagccatggatgagcaatgcctgcaccatgtgtgaaccacgcctgaatcacggttgaaacactcctcaaccttaggtgacacacatgtaagccatgtgtgagccacacctgggttacacctgaaccatttgggagccacacctgaaccatgactgaaccacatgagacacatttgaaccacatgggaaacatgtgtgaagcacacatgttcaaggtgtgtacctcacgtgaaccacaagaaagccactcgtgaatcatggctgggccatgcgtgagccacgtgccagccacgtctgagtaggtgggagccatgtgtcagcagcgagtgagtcacgtgtgtggtacacatgaatgacatgtaacccatgcatgaaacacatgtcttccaggcatggataatgtgagatgaatgcctgagtcacgtgtcagccatgcctgcatcatgtgtcagccaaacctcaaacatctggcacctccgtgtagaccacacaccagccagcactgagccacgtgaaggccgtgcatgaaccaggtgcgagccacacctgcgtgatgtgacagtcatgcctgagtcacgtgactgcctcacctgagtcatgtgtcaaccatgcctgaaaaacgtgtgagccacgcctgagtcgcatctaagcaatgccgaagtcacatgccagccgcaactgaaccatgtgccagtcccaatttagccacacacctgcttcacttgaatcacgtgaaccacaagggagccacttgtgaatcatggctaggccatgcgtgagccatgtgccagccacgtctgagtaggtgggagccatgtgtcatcagcaagtgagtcacctgtgtgccacacatgaacgacatgtaacccatgcatgaaacacatgtctgccaggcatggataatgtgcgataaatgcctgagtcacatgtcagccattcttgcatcatgtgtcagccacacctgaaacacctggcacccctgcaggaaccacacaccagccagccctgagccatgtgaatgccgtgcatgaagcagctgcgagccacacctgcgtgatttcacaggcacacctgtgtcccgtggctgcctcacctgagtcatgtgtcagccatgcctgaaaaacgtgtgagccacacctgagtctcatctcagccatgctgaagtcacatgctggtcaccactgaaccatgtgtcagtcccaatttaaccacacgcccacctcacttgaagcacatggcagccacgctcgagacacctgcttgccatgcctgaaccatgtgccaaccatgccacaatcaagtgtgagccacgcctgagcagcaccacagccatgcatgagccacacctcagccgtgtgggagccatgcatgacaaatgcctgaatcatgcatcagccacgtgtgacccccttctcttttgtgcctgcatcatgtgtgagccttggctgagccacacctgagccatgtgtgggccatgccttaatcatgtgtgaatgtctcctgaagcatttgtgagttactcaagtcacgtgtgagccatgcctgaattacatctgaaccatgtgtgagccacaagtgaaccatgcctgaaccacatctgaggcacccttgaagcacacgtgaaccacatgggaagcacccatgttcaatgcttgaaccacaccagaacctcaggtgagccacacatgaaacacaggtgaggcatgcatgaaccacgttccagccacggctgtgtatttgggggccacgtttaagcaacgtgggagccacacctgtacgacatgtcccacatgtcaccacatgtctgccacacatggataatatgcgatgaatgcctgagtcccctgtgggccatgcctgcgtcatgcatcagccccgcatcagagaagtgccagccacacctgaatcacctgtcaccaacatcctacccacatgtcagccatgcctgagccatgtcaacgatgacacaccaagtgtcagccacagagcaatcacttgtcactgtggcctgaccgaagcatcacataccactggaacccatgtgtgacacgccttaatcccatgcctgaaacacatgccagcaacgcctgaatctcgtgtcagacatgcctgagccacgtgacaaccatgccagagccataccccagcatggcatgagcctcacctgagacatgtgttagccttgcgtgacaaaagactgaatcttgcgtcagccacatgcgacccagttctgtttcgtgcacacatcacgtgtgagccttgggtgagctgcacctgaaccacgttttggccatgcctaaatcatgtgtgaaagtctcctgcagcatttgtgacccacacaagtcatgtgcgagccatgcctgaattacatctgaaccgtgtgtgagccacaagtgaaccatgcctgaaccacatgtgaggcccccttgaaccacatctgaagcacatgggaagcacccatattcaatgcttgaaccacacatgaacctcaggtgagccacacatgaaacactgctgaggcatgcatgagccttgtgccagacatgagtgagtatgtggggtccacgtttcagcaatgtgggatccacacctgtacaacatgtcccacatgtgaccacatgcctgccacgcatggataatgtgcaatgaatgcctaaatcatgtgtgagcaatgcttgcgacatgcgtcagccccacatcagaaaattgccagccacacctgaatcacccgtcacccacatccgaaccacatgtcaggcacgcctgagccatgtgtcaactgcgacacaccaagtgtcagccacacagcaatcacgtgtcactgtggcctgaatgaagcattgcatacctctggaacccatgtatgacacgccttaataccatgcctgaaacacatgccagccacacctgaatctggtgtcagacatgcctgagccacgtggcaaccatgccagagccacgccccagctagtcgtgagcctcacctgacacatctgttagccatgtgtgacaaactcctgaatcatgtgtctgccacacctggccccggtctgaggctcgcctgaacaacaggtgagaaatggctgagccatgcctgcgccacgtgtgagccacgcctgaatcacgggtcaaacactcctcaaccatatgtgacacgcacacgagccatgtatgagcaacacctgggttacacctgaaacatttgggagccatgcctgaaccatgactgaaccacatgagacacactggaaccacatgtgaaacacgtctgaagcacacacattcaaggtttgaatgacaccagaaccacaagggagccactcgtgaaacatggctgggccatgcgtgagccacgtgccagccacgtctgagtaggtgtaagccatgtgtcagcagggagtgagtcacgtgtgagccacacatgatcgacatatatcccattcatgaaacacatgtctgccaggtacggataatgtgcaatgaatgcctgaatcacatgccagccatgactgcatcatgtgtcagccacacctgaaacacctgacacccatgcgtgaaccacacagcagccacccttgagccacgtgaaggctaaggatgaacgaggtgcgagccacacatgcgtgatgtcacaggcacgcctgtgtcatgtggctgcctcgcctgagtcatgcgtcagccatgccagaaaaacgtgtgagacacgcctgtctcatctcagccatgctgaagtcacatgccagccaccactgaaccatgtgccagtcaccatttcaccacacgccagcctcacttgaagctcgtgtcagccacgctggagccacctgcctgccaggcctgaaccacgtgccaaacatgccacaaacaagtgtgagccacgcctgaacagcaccacagtcatgcatgagccacactttagctgtgtgggagccatgcatgacaaacactggcatcatgcatcagccatatgtcaccaatttctgtggcttgcctgcatcacgtgtgagccttggctgagctgctcctaaaccatgtgtgggccatgcctaattcatgtgtgaaagtctcctgcagcatttgtgacccacacaagtcacgtgtgagccatgcctaaattacatctgaaccgtgtgtgagccacaactgaaccatgcctgaaccacatgtgatgcaaacttgaaccacatctggaccacatgggaagcacccgtgttcaatgcttgaaccacacatgaacctcaggtgagccacacatgaaagacagctgaggcatgcatgagccacgtgccagccgtgactgaatttgtggggcccacgtgtcagcaacgtgggagccacacctgtaggacatgtcccaaatgtgaccacgtgtctgccacgcctggataatgtgcgatgaatgcctgagtcgcgtctgggccatgcctgggtcatgcattagccccgcatcagaaaggtgccagccacacctgaatgacctgtcacccacttctgaatcacatgtcaggcacgcctgagccatgtgtcaactgtgacacagcaagtgtcagccagacagcaagcacgtgtcactgcagctggaacaaagcatcacataccaccagaacaagtgtgcggcacacctgaatctcatgcctgaaacacatgtagcaatgcctgagtgtcgtgtcagacatggctgagccacgtgccaaccatgccacagccacgccccatccatgagtgagcctcacctgaggcatgtgttagccaagtgtgaaaaactcctgaatcatatgtcagccacaccgggccccggtctgaggctcgcctgaactccaggtgagccatggctgagccatgcctgcaccacgtgtgagccacgcctgaatcacggctgacacactcctcaaccatctgtgacacgcacatgagccatgtgtgtgcgacacctgagtttcacctgaaccatttgggagccacgcctgaaccatgactgaaccacatgagacacacttgaaccacatgggaaacacgtctcaaacatacacgttctaggtttgaacctcacgagaaccacaagtgagacactcatgaaacatggctgggccatgcgtgagccacgtgccagcaacgtctgagtaggtggaatccatttgtcagcagtgtgtgagtcacgtgtgtgccgcacaagatcgacatgtaacccatgcatgaaacacaagtctgccaggcacggataatgtgtgatgaatgcctgagtcacgtgtcagccatgcctgcgtcatgtgtcagccacccctgaaacacctggcacccatgcgtgaaccaagcaccagaacccctgagccatgtgaaggacgtgcatgaagcaggtgtgagccacagctgcgtgatgtgacaggcacgcctgtgtcacctggctgcctcacctgagtcatgtgtcagccatgcctgaaaaacgtgtgagccatgcctgagtctcatctcagccatgccgaagttacatgccagccacaactaaactatgtgccagtcccaatttcaacatatgccagcctcacttgaagcacgtgtcagccatgctggataaacctgccggccatgcctgaaccacgtgccaaccatgtcacaatcaagtgtgagccacgcctgagcaacaccacagccacgcaagaggcacacctcagctgggtgtgagccatgtgtgacaaacgccagaatcagatgtcagccacatgtgacccatttctgtggcatgcctgcatcacgtgtgaaccttggctgagctgaacctcaaccatgtgttggccatgcctaattcatgtgtgaaagtctcctgcagcatttgtgacccacacaagtcacgtgtgagtcatgcctgaattacatctgaaccgtgtgtgagccacaactcaaccgtgcctgaaacacatgtgatgcaaacttgaaacacatctggaccacatgggaaggaccagtgttcaatgcttgaaccacaaatgaacctcaggtgagccacacatgaaacacagctgaggcatgcatgagccacgtgccagccgtgactgagtatgtggggcccacgtttcagcaatgtgggagccacagctataggatatgtcccatgtgtgaccacatgcctgccactcatggataatgtgcgatgaatgcctgagtcacgtgtgagcaatgcctgcgtcatgcgtcagccccgcatcagaaaaatgccagccacagctgaatcacctgtcacccacatctgaaccacatgtcaggcacgcctgagccatgtgtcaactgtgacacacgaagtgtcagccacagagcaagcacgcgtcactgctgcctgaacgaagcatcacataccactggaacccgtgtgccacacacctgaatcccatgcctgaaacacatgccagcaatgcctgaatctcgtgtcagacatgccggagccacgtggcaaccatgccagagccacacaccagccatgtgtgaggctcacctgagacatgtgttagccatgtgtgacaaactcctgaatcatgtgtcggccacacgtggccctggtctgaggctcggctgaactccatgtgagccatggctgagccatgcctgcaccacgtgtgagccacgcctgaatcacagctcaaacactcctcaaccatagatgacacacacatgagccatgtgtaagccacaccttggttacacctgaaccatttgggagccacacctgaatcatgactgaaccacatgagacacacttgaaccacatgggaaacacgtgtgtaacacacattttcctggagtgaaccacacgtgaaccacaggggagacactcgtgaatcatggctgggccatgcgtgagtcacgtgccagccacgtccgagtatgtgggagccatttgtcagcagccagtgagtcacgcgtgtgccacacatgaacgccctgtaacccatgcatgaaacacatgtctgccaggcatggataatgtgcttcaaatgaggcgggtgtgtggttgaattgggattggcacatggttcagttgtggctggcatgtgactttggcatggctgagatgagactcaggcgtggctcacacgtttttcaggcatgactgacacatgactcaggtgaggcagccacgtgacagaggcgtgcctgtcacatcatgcaggggtggatcgcacctgtttcatgcacagacctcatgtgggtcacggctggatgcgtgagtagttgacgcaggggtgccaggtgtttcaggtgtggctgacacatgacgcaggcatggctgacacgtgactcaggcattcatcgcacattttccatgcctggcagacatgtgtttcatgcatgtgttacatgtcattcatgtgtagcacacacgtgactcactcgctgctgacaaatggctcccacctactcagacgtggctggcacgtggctcacacatggcccagccatgattcactagtggctcccttgtggttcacgtgtggatcacaccttgaacatgtgtgcttcacacgtgtgcagcatgtggttccagtgtgtctcatgtggttcagtcatgattcaggtgtggctcccaaatggttcaggtgtaacccaggtgtggctcacacatggctcatgtgtgtgtcacctatggttgaggagtgtttcacccgtgattcaggcgtggatcacacgtggtgcaggcatggctcagccatgtctcacctgttgttcaggcgagcctcagaccgggccaggtgtggctgacacatgattcaggagtttgtcacacatggctgacacatgtgtcaggtgaggctcacaccatgctggggcatggctctggcattgttgccacatggctcaggcaggtctgacatgagattcaggcgttgctggcatgtgtttcaggaatgggattaaggtatgtcacacatgggttccagtggtatttgatgcttcattctggccgcagtgccacatgattgctgtgtggctgacacttggtgtgtcacagttgacacatggctcagacgtggctgacatgtattttggatgtgaatgacaagtgatttaggtgtggctgacaattttctgatgcaggtctgatgcatgatgcaggcatggaccacacgtgactcattcattcatcgcacattatccatgactgtcaggcatgtggtcacatgtgggacatgtcatacaggtgtggctcccacgttgctgacaccagggccccacatactcagtcaaggctggcacgtggctcatgcatgcctcagctgtgctttatgtgtggctcacctgaggttcatgtgtggttcaagcattgatcatgggtgtttcccatgtggtccagatgtggttcaagggtgcctcacatgtgcttcagagtgaaccacatgagatacactggaaccacatatgaaacacgtatgaagcacacacgttcaaggtttgaaccacacgtgaaccacaatggagccactcgtgaaacatggctgttccatgcatgagccatgtgccagccacttccaagtaggtgggagccgtttgtcagcagtgagtgagccacgtgtgtgccacacaggaatgacatgtaacccatgcatgaaacacatgtctgataggcacggattctgtgcgatgaatgcctgagtcacgtgtcagccacacctgaaaccaccttacctgagccatgtgtcagccacgcctcaacaatgtgtgaaccacacctgtgtcaaagctcagctgcgccaagtcacgtgccaacctggcctgaaccaagtgccagtcacacttgaaccacaggtccgcctcacttgaagcatgtgtcagccacactggcacaacatttctgccatgcttgataaatgtgccacccgtgccacaaacacatgtgagccatgcctgagcaacaccacaggcatgcctgagccacacctgaaccatgtgtgagccatgcatgacaaaagcctgtatgatgtgtcagtaacatgggatccagttctgtggcacacctgtgtcacgtgtgagccatggctgagctatgcctgaaccacgtgtgagattgtcctcaaccatatgtgacccacacgagttgtgtgagagccacgattgaattacactgaaccatgtgtgagccatgcaggaaccacatgggagacacccttgaagcacatttgaaccacctgggaaacacacatgatcgatacttgaaacacacatgaaccgcaggggagccacacatgaaacacagctgaggcatgtgtgaggcacatgccagtcatgagtgagtatgcaggagccatgtttcagcaacctgtgagtcacgtggcagccacccatgtactgtatgtgacacacgcatgaccacatttttgccacacatggatcctgtgcgatgcatgactgagtcacgtgtcagccaagcctgagacatgtgtgagccacgccagagtcatatttcacacatgcctgagtcacatgtcagccacgcctgaaccaccttccacccatgtgtgaaccctgcacctgctacccctgaactccacgaaagccatgcatgaagcatgtgtgaaccacaccagagtgccgtgtgacgcatgcctgtgtcatggggcagcctcacgtgagtcatgtgtcagccacacctgaataacgtgtgagccacgcctgagtcacgtctcagcagtgccacagtcacatgtcagccacgcctgaaccaagtgccagtcacacttgaaccacagatcagcctcacttgaatcacgtgtcagccacactggctcaacttgcctgccatgactgaaacacttgcaaaccatgccacaaacacatgtgaaccacgcctgagaaacaccacagccaggcatgagccatgcctgagcctagtgtgagccaagcatgacaaaagcctgaatcacgtgtcagcgacttgggaggcagtgatgtggcacgccttcatcatgtgtgagccatggctgagctatgacttaagacccagggaaagtgtcctctacgatatgtgacccacacgatccttgtgtgagcaatgcctgaattacacccgaaccatgtgtgagccatgcatgaaccacatgtgagacacccttgaagcacatctgaaccacctgtgaaacacacatgatcggtgcttgaaccgcacatgaaacgcagtggagccaaacatgaaacacagctgagtcactcatgtgccacatgccagccatgactgagtatgcgggagccatgtttcagcaacctgggagtcacatgggagccacacctgtacggcatgtcacacactcctgaccacatgtctgccacacatggatcctgtgccactcatgcctgagtcacatgtcagccatgactgagacaagtgtgagccaccccagggtcatgtttcacacatgcctgtgtcacatgtcagccacgcctgaaccaccagccacccatgcatgaatcctgcaccagccacccctgaaccacacaagggccatgcatgaaccatgtgtgaaccacaccagagtgacgtgtcatgcacccctgtgtcacgtggccacaacacctgagtcatgtgtcagccacgcctgaataaactgtgagccacgcctgagtcacgtctcagcaggctgatgtcacatgccagccaggcctgaaccaactgccagtcacacttgaaccacaggacttcctcacttgaagcacgtgtgagccacactggcacaacttgcctgccatgcctgaaccacgtgagaaccatgccacaacacaggtgcgtcacgaatgagcagtaccacggctgtgcatgtgccacacatgacccatgtgtgagccatatgtggcaaaagcctgaatcatgtgtcagatatgtgggagtcagtgctgtggcacgcctacataatgtgtgagccatggctgagctatgcctgaaccacatgtgaaagtgtcctctacgatatgtgacccacacgagtcttgtgtgagcaatgcctgaattacacccgaaccatgtgtgagccatgcatgaaccacaggtgagacacccttgaaggacatctgaaccacctgggaaacacacatgatcgatgcttcaaccacacatgaaccacagtggagccaaacatgaaacacagctgagccaggcgtgtgccacatgccagccatgactgagtttgcgggagccacgtttcagcaacctgtgggtcacgtggaagccacacctgtacggcatgttgcacaggcatgaccacatgtctgccagacatggatcttgtgcgatggatgcctgagtcacgtgtcagccatgtatgagacatgtgtgtgccaccacaggatcatgtttcacacacgcctgagtcacatgtcagccacgcttgaaccacctgtcacccatgcgtgaaccctgtaccagccacccctgaaccacatgaagtccatgcatcaaccatgtgtgaaccacacctgcgtgatgtgtcaggcacgcctgtgtcacgtttccaactcacctgagtcatgtgtaagccacgcctgaacaacgtggggatcccgccggtgtcaaggctcagccacaccaagtcacgtgccagccaggcctgaaccaaatgccagtcacacttgaaccacagatcagcctcacttgaagcacgtgtcagccagactggcacaaattgcctgccatgcctgaaccatgtgccacccatgccacaaacacatgtgagccacgcctgaccaacaccacagacatgcatgagccacacctgaaccatgtgtgagccatgcatgatcaagcctatattatgtgtcagcaacatgggagccagttctgtggcacacctgagtcacgtgtgagccatggctgagctatgcctgaaccatgtgtgagagtgtcctcaaccatatgtgacccagacaagtcgtgtgagatccatgcctcaattccacctgaaccatgtgtgagctatgcaggaaccacatgggagacacccttgaaccacatctgaagaacgtgtgaaacacacatgttccatgcttgaagaacacatgaaccagaggggagccacccatgagacacagctgagccatgcgtgagccacgtggcagccatgactgtgtatgttggagccacatttcagcaacctgtagtcacgtgggcgccacccatgtacggcatgtgactcctgtgtgatcacatttccgtcacacatggatactgggcgatgaatgcctgagtcacatgtcagccatgcctgacacatgcgtcagccacaccagggtcctgtttcacacatcccggagtcacatttcagccacgactgaaccacgtgccacccatgcatgaaatatgcaccagccacccctgaaccacacgaaggacatgcatcaaccatgtgtgaaacccacctgcatgacttttcaggcacacctgtgccacgtttacacctctcctgagtcatgtgtcagccgtgcctgaacaacgtgtgaaccacgcctgtgtcaaggctcaggtgcaccaagtcatgtgccaggccggcctgaactaagtgccagtcacacttgaaccacaggtcagcctttcttgaagcacgtttcagccacactggcacaacttgcctgccatgcctgaaccacatgccatccatgccacaaacacatgtgagccacacctgagcaacaccacagacatgcatgagccacacctgaaccatgtgtgggccaagcgtgatcaaagcctgtatcataagtcagcaacatgggagccatttctgtggcacgcctgcatcacgtgtgagccatggctgaggcatgcctgaatgtggatgctgtgaacatgcagaggatgcagtgatactgcagtgattgcagtgcgcctgcgttttctcaccagctggaggcagtgttgctgcagtggtcgaagtgccaccttctgtgtccctgaaggtgaatgtagtgcccatgcagtggaggcagtgaacctaaatgtttatgcagtatgttgtgacggaggatgcagtgcccatgaaggcggatgcagtgtccctgcagttgttgcagggcccccggcattgtgctggaatgtgcatgcagtggtcatgcagtggtcatgcagtggatgcagtgtctcacaaggcggatgcagcatgttttttggaggatgcagtacccatgcagtggatgcagtgtacctaaagctttatgctgtattttgtgacgaaggatgcagtgagcatgaaggtggaagcagcatccctgcagtggttgcagggctccctgcattgtactggaatgtggatgcagtggtcatacagtggatgcagtgtccctctatgtgcatggagtatgctatgacagatgatgcagtgctaatgaggtggatgcagtgttgctgcagtaattacagtgacccctgcagtttacctaaatgtggatgcagtggtcatgcagtggatacagtgtccctcaaggtggatgaattatgctgtgatggaggattcagtgatcatgaaggaggatgcagtgatcctgcagtcattgcagtgcacctgcagtgccacttcagctggctactgtgtccctgcagtacttgcagtgccccattctgtgtccctgagtgtggatgcagtgcccatgcagtggatgcagagtacaataaggtggttgccatatgtagtgacagcggatgcagtgcccacgaattggatgcagtgagccggcagtgatggcagtacaccttcagtaccacttcagctggatgcagtgtccctgcagtggttgcaatgccccctgcattgtcctggaatgtggatgcagtgctcatgcagaggatgccgtgtcccacaaggtgcatgccatatgttgtgatggatgatgcagtacccatgaaggtggatgcagtaatccagcagtggttgcagtgcaccctgctgtgtccctgaatgtggatgctgtgaacatgcagtggatgcagtgatcctgcagtgattgcagtgcgcctgaatttccacatcagctggaagcagttttcctgcaggggttccactgccaccttctgtgtccatgaaggtgatttcactgcctgtgcagtggatgcagtgtacaaaaaggtttatgcagtatgctgtgacggtggatgcagtgcccatgatggtggatgcagtgtccctgccttggtttcattgccccggccttgtcttggaatgtggatgcaggagtcatgtagtggatgcagtgtctcaaatggaagatgcagtatgttttgttgtaggatgcagtgcccatgtaggtgtatgtggtgaagctgcagtggttgtagtgcgccctacagtttccctgaatgtggatgcagtgcccatgcagtgcatgcagtgtaccgcaagatggatgcggcatgttgtgacggaggatgctgtgcccacgaaggtggatgcagtgagcctgatgtgattgcagtgtgcctgcagtgccacttcagctgtatgcagtgttgctgcagtggttgcagtgcaccatgcattgtccaggaatgtggatgcagtgccgattccgtggatgaagtgtcccacaagttggatgcagtatgttatgacggatgatgcggttctggtgaaggtggatgcagtgtgcctgtagtgcttacagtgcccccggcattctctggaaatgtgaatgcagtagtcatgcagtggatgctgtgtccctcaaggtggatgcagtatgttgtcatggaggatgcagggccatgaagttgtatgcagtgatgctgcattgattgcagtgccccgtacagttccctgaatgtggatgttgtgtccatgaaatagtggcagtgtcccacaatgtggatgtcgtatgttgtgatggaagatgctgtgcccaacaaggtggatgcagtgagccagtgctgaatgcagtgcgcctgcagtgcgacttcagctgtatgcagtgtcctggcagtggttgcagtgccccccgcattgtccacgaatgtggacacagtagtcatgcagtggatgcagtgtcccataaggtggatgcggaatgttctgatggaggatgcagtgtccacgaaggtggatgcagtgagcctgaagtgatggcagtgtgcctgcagtgccacttcagctggatgcagtgttgctgcagtggttgcagagccagcaggagtgtccctgaacttgaatgcagtgcccctgcattggaggccgtgtacctaaaggtttatgcagtatgttgtgacggagggtgcagtgtgcatgaaggcggatgcagtgtccctccagtggttgcagggtccccagcatagtgctggaatgtagatgcagggttcatgcagtggatgcagtgtctcacaaggtggatgcagtatgttttgtcggaggatgcagtgcccacgaaggtggatgcagtgagtctgtgctgaatgcagtgcacctgcagtgcaacttcagctgtttgctgtgtccctgcagtgggtgcagtgaccactgcattgtccgagaacgtggatgcagtgcccatgcagtggatgcagtgtcgcacaatgtgcatgcagtatgttttgacggagaatgcagtgcccatgaaggtggatgcagtgatcctgcactgatttcagtgcaccctgcagtttacctgaatttggatgcagtgctcatgcagttgatgcagtgtgcctcaaggtggatgcctcgtgatgtgttggagggttcactgatcatgaaggaggacgcagtgatccggcagtcattgcagtgaactttagtgccactaaagctggctgtagtgtccctgcagtggttgcagagccccgtcctatgtccctgaatgtggatgcagtgcccatgcagtggatgaagagtaccaaaagttggctgccgtaagttgtgacagagcaagccatgcccacgagatgtatgcagtgagccggcagttatggcagtacgccttgactgccacttcagttggatgcagtgtccctgcagtggttgcaatgacccctgcattgtcctggaatgtggatgcagtactcatgcagtggatgcagtgtgccacattgtggaggcattgtggtgtgttgcgttatgcagtgccgatgaaggtgaatgcagtggtcctctagtgatggcagtgtgccagcagtgccccttctgctggatgcagtgttgctgcagtggttgcagtgcctcctgcattgtctgggaatgtggatgcagtggcaaggcagtggatgcagtgtcccacaaggtagatgcagtatgttatgatggatgatgcagttctcatgagggtggatggagtgtaccagcagtggttgcagtgcacgcttctgtgtccctgaatgtggatgctgttaacatacagtggatgtagtgatcctgcagtgattgcagtccgcctgcatttcctcatcagctggaagcagtgttgatgctgtggttgcagcgcccgctacagttccctgaatgtggatgcagtggccatgcagtggatgcagagtaccaaatgttagttgccgcacgttgtgacagaggatgcggagccctggagttggatgcagtgagccggcaccgcttgcagtatgccttcagtaccacttcagctagatgtagtgtagctgcagtggttgcaatgccccctgaattgtcctggaatgtggatgctgtgctcatgcagtggatgcagtgtcccacaatgtggtggcattgtggtgtgttgtaggatgctgtgccaatgaaggtgattgcagtgatcctgcagtgatggcagtgcgcctgaatttccacttcagctggatgtagtgtcctgcagtggtagcagtgccccgtcctgtgtccctgaatatggatgaagtgcccatgcagtggatgcagagtaaaaaatgtttgccaccgtatgttgtgacagaggatgcagagaccctggcgttggatgcagagagccagcagtgattgcagtacaccttcagtgccacttcaggtggttgtagtgttgctgcagtggttgcagtgccccctgcattgtccgggaatgtggatgcagtgcccaggaagtggatgcactgtcccacaaggtagatgtagtatgttatgacggatgatgcagttctcataaaggtggatgcagtgtccctgcagtgcttgcagtgtcccccacattctctgggaatgtggatacagtagtcctgcactggatgcagtgtcccacaaggtggatccagtatgttgtgatggaggatgcagggcccatgaaggtagatgcagtgatgctgcagtggttgcagtgccccctactgttccctgaacatagatgcagtgcccatgcagtagttgcagtgtcccaaaaggtggatgtcgtatgttgtgatggaagatgcagtgcccacgatggtggatgcagagagcctgggttgaaggcagtgctcctgcagtgcgacttcaggtgtatgcagtgtccctgcagtggttgcagtgcccactgcattgtccgagaacgtggatgcagtgcccaggcattggatgcagtgtcccacaaggtttctgcagtatgttgtgacggaggatgcagtgcccatgagggtggaggcagtgatccggcagtggttgcagtgcaccctgctgtgtccctgaaggtgcatgctctgaacatggagtggatgaagtgatcgtgcagttattgcagtgtgcctgcatttccacgtcacctggaagatgtgtccctgcaggggttgcagtgccgtcttctgtgttgctgaaggtgaatgcagtgcccatgcagtggatgcagtgtacctaaaggtttctgcagtatgttgtgacggaggatgcagtgcccatgaaggaggatgcagtgtccctccaatcgttgcagtgcccccagcaaggtcctgaaatgatgaagtgtctatgcagtggatacagtgactcttcagtgattgcagtgtgcctgcagtgccacttcagctggatgcagtgtagctgcagtggtatagacccctgccatgtccctgaatgtggatgctgtgcccatgcagtgtctgccgtgtgactcaaggtggatgcactatgttgtgaagcaggattcagtgcccatcaaggacaattcagtgttcctgcagtcattacagtgcacctggagtgccactttatctggatgcagtgtcccttcactggttgcactgcacactgctgtgtgcctgaatgtggatgctgagaacatgcagtggatgcagttactctgcagtgattgcagtgtgcctgcatttcctcatcagctggaagcagtgtccctgcagtggttgcagtgccgccttctgtgtcccagaaggcgaatgcagtgaacatggagtggaggccatgcacctaaagatttatgcagtatgttgtgatggaggatgcagtgcgcatgaaggcagatccagtgtccctgtagtgattgcagggctcccagcattgtgctggaatgtggatgcagtggtcatgcagtggatgcagtgtctcacaagacagatgcagtatgttgtgtcggatgatgcagtgcccatgaaggcagaggcagtgaacctgcagtggttgcaatgccccctacagtttccctgaatgtggatgcagtgcccaaacagtgcatgcagtgtcccaaaaggtggaagcagtatgctgtgacggaggatgcagtgcccacgaaggtggatacagtgagcctgaagtgattgcagtgcacttgcagtgccacttcagctggatgcagtgttgctgaagtggttgcagagctaactgcagtgtcccagaacgtggatgcagtgcccatacagtggatgtagtgtcccaaaatgtgcatgaagtatgttgtgatgcgggatgcggtgcccatgaaggtggatgcagggatcatgcggtggttgcagctccccctgcagtttacctgaatgtggatgcatgctcatgcagtggatgcagtgtccctcaaggaggaagccttatgatgtgttgcaggattcagtgatcatgaaggaggatgcagtgatactgcagtgacacttcaggtggctgcagggtccatgctgtagttacaatgcaccctcctgagtcagtgaatgtggatgcagtgcccatgcagtggatgcagagtaccaaaagttccttgccacatgttgtgacagaggatgaggagccctggtgttggatgcagagagccggcagtgattgaagtatgccttcagtgccacttcagctggatgcagtgtctctgcagtggttgcagtgcaccctgcattgtccgggaatgtggatgcagtgcccaggaagtggatgcagtgtcccacatggtggatgcagtatgtcatgacggatgatgcagttctcatgaaggtggatgcagtgtccctgcagtgcttgcagtgccccccgcattgtccggaaatgtggatgcagtagtcatgcagtggatgcattgtcctacaaggtggatgcagtatgttgtgatggaggttgcagggcccatgaagttggatgcaaggatgcttcagggttgcagtcctccctacagttccatgaatatggatgcagtgcccatgcagtagttgcagtgtcccacaaggtggatgtcgtatgatctgatggaagatgcaggcaccatgaaggtggatgcagtgattgtgcagtggtttcagtgagccctacagttccctgaatgtggatgcagtgcccatgcagcagttgcagtgtcccacaaggtggatgtcgtatgttgtgatggaagatgcagtgtccacggaggtggatgcagtgagcctgtgctgaatgcagtgtgcctgcagtgagacttcagctgcatgcagtgtccctgcagtgatgactacattgtccaagaacgtggatgcagtgcccaggcattggatgcagtgtcccacagttgcatgcagtatgttgtgagggaggatgcagtgcccatgaaggtggatgcagtgatccggcagtggttgcagtgcatcctgctttgtccctgaatgtgcatgctctgaacatggagtggatgcagtgatcctgcagtgattgcagtgtgcttgcatttccacatcagctggaagcagtgtcccagcagaggttgcagtgctgacttctgtgtcactgaaggtgaatgtagtgcccatgcagtggatgcagtgtacctaaaggtttatgcagtatgttgtgactgaggatgcagtgcccatgtagggggatgtagtgtccctccaggggttgcagtgccaccggcattgtcctgaaatgttgatgcagggcctatgcagtggatgcagtgattcttcagtgattgcagtgcgtctacagttccacttcaactggatacagtgtagctgcagtggttgcagagcccgtgccatgtccctgaatgtggatgctgtgcccatgcagtgtctgcagtgtgactcaagttggatgcagtatgttgcaaagtaggattcactgcccatgaaggacgatgtaatgatcctgcagtcattgcattccacctgaagtgccacttcttctggatgcagtgtcccggcagtggttgcagtgccgccttctgtatccctgaaggtgaatgcagtgcccttgaagaggaggcagtgtacctaaaggtttatgcagtatatttgacggaggatgcagtgcacatgaaggtggatacagtgtccctcctgttgttgcaggctccccggcattgtgctggaatgtggatgcaggggtcaagcagtggatgcagtgtctcacaaggcagatgcagtatgttttgtcggtggatgcagtgcccacgaaggtgggagcggtgaacctgtagtggttgcagtatgccttcagtgccacttgagctggatgcagtgtccctgcagttgatgcaatgccccctgcattgtcctggaatgtggatgcagtagtattgcaatggatgcaatgttccacaaggtggatgccgtatgttgtgatggaggatgaaggtggatgcagtgatctgtcactgattgtgctgcacactgctgtgtcccagaatgtggatgctgtgaacatgcagtggatgcagtgatcctgcagtgattgcagtgtgcctcgtttccacatcagctggaagcagtgtcccagcagtggttgcagtgcctccttctgtgtccctgaatgtgaaggcagtgcccatgcagtggaggcagtgtacctaaaggtttctgcagtatgttgaggcggaggatgcagtgcccatgaagttggatgcagtgtccctgcagcggctgcagtgcctctggcattttcccataatgtggatgcaggggtcatgcagtggatgcagtgcctcacaagacagatgcagtatgttttgatggaggatgctgtgccacttcagccagatgcagtgttgctgcagtggttgcagagccatctgcagtgtccctgaacgtggatgcagcgcccatgcagtgcatgcagtgtcccacaaggtggatgcagtatgatgtgacggagaatgcagtgcccacgaagttggatgaagtgagctggcagtgattgcagtgtgcctgcagtgccacttcagctgcatgcagtgtcactgcagtggttgcagtgccccattctgtgtccctgaatgtggatgcggttcccgtgcagaggatgcagagtaccaaaagttggttgctgtatgttgtgacagacaatgcagtgcccacgagttggatgcagtgatcctgcagtgattacagtgcgtcttcattgccactacagctgaagtcagtgtccttgtagtggttgccatgccccctgcattgtccgggattgtggatgcagtgcccaggcattggatgcagtgtcccacaaggtggatgcagtatgttatgacggatgctgcagttctcatgaaggtggatgcagtgtcccagcagtgcttgcagtgtcccaggattgtccgggaatgtggatgcagtagtcatgcagttgatgaagtgatcctgcagtgattgcagtgcgcctgtgtttccacatcagctggaagcagtgtccctgcaggggttgcggtgctgccttctgtgatccagaatgtcaatgcagtgcccatgcagtggaagcagtgtacctaaaggtttatgcagtatgttgtgacggaggatgcagtgcccatgaaggtggatgcagcgtccctgcagttgctgcagttcccctggaattcttctgaaatgtgtatgcatcagtcatgcagtgaatgcagtgtctctcaaggcagatgcagtatgatttttggaggatgcagtgcccagtaaggtttaggcagtgaacctgcagtggttgcagtgccccctacggtttccctgaatgtggatgcagtgctcatgcagtagatgcagtgtcccaaaatgtggaggcattgtggtgtgttgtagtatgcagtgccgatgaaggtgaaggcagtgatcctgcagtggttgcagtgccccctgcagtttacctgaatgtggatgcagtgctcatgcagtggatgcagtgtccctcaaggtggatgccttatgatgtgttggaggattcagtgatcatgaaggaggatgcagtgatccagcagtcattgcagtgaacttgcagtgccacttcagctggctgcagtgtcccttgagtggttgcagtgccccctcctgtgcccatgagtgtggatgcagtgcccatacagtagttgcagtgtccaaaaaggtggatatcgtatgttgtgaggaaagatgcagtgcccacagaggtggatgcagtgagcctctgctgaatgcagtgcacctgcagtgcaacttcagctgtatgcagtgtccctgcagtggttgcagttctcactgcattgcccaagaatgtggatggagtgcccatgcagtggatgcagtttcccaaaaggtgcatgccgtattttgtgactgtggatgcagtgcccatgaaggtggatgcagtgatccagctgtggttgcattgcaccctgctgtttccctgaatgtgcatgctcagaacatgcagtgaatgcactgatcctgcagtgattgcagtg

SEQ ID NO: 75 - DNA, 3201 bp, Equus caballus
gccattcattgccaagtgcaccctggcaggcttccaatttcatcccggaggccagagttccctgaaatgtgaattccagtgctcatgcatgtgattgatgtatgtttcattgagggatagcagtgccccatgaagacaggttgcattgatccttcagtgattgccagtgtgcctgcagtgccacttcagcaggatccagagtcactgcaggagtttcagcgcctatagcactgtccctgttcgtggctgcagtgcccactcaatggctgcagtgtctctgaaggtagatgcagtatgttgtgttggaggatgcagtgcccaggaaggtggatgcagtgtcgcacaagtcagatgcagtatgttgtaatggaggatgcagtgcccatgaatgtggatgcggtgatcctgcagttgttgcagtgcccacttcaggttccctgaatgtggatgcagtgcccatgcagtggatgcagtgctgcacaaggtgaatgcagtaggttgtgacggaagatgcagtgcccacgactgcgaatagagtgaggctgcagtgattgcagtgcacctgcagtgtcacttcagcggtatgcagtgttgctgcagtggttgcagacccaaatgcagtgtccctgagcatggatgcaaatcccaggcagtggatgcagtgtacctcaatgtgcatgcagtatgtagtgagggaggatgcattgcccatgaaggtggatgcagtgatcctgcagtggttgcagtgccccctgcagattccctgaatgtggatgcagtgctcatgcagtggatgcagtgtccctcaaggtggatgccttatgttgtaatggaggattcagtgatcatgcactcattgcagtgcacctcccagtgcgacttaaactggctgcagtttccctgcagtggttgcagtgccccgttctgtgtccctgattgtggatgcggtgccgatgcagtggatgcagagtaccaaaagttgcttgccgtatgttgtgacagaggatgcagtgcccacgaggtgtatgcagtgagtgcacactgattgcagtacaccttcagtgccaattcagctgtatgcaatgttcctgcagtggttgcagtgcccactgcattgtccgagaacgtggatgcagtgcccaggcattggatgcagtgtccaacaaggtgcatgcagtatgttgtgatggaggatgcagtgcccatgaaggagaatgcagtgatccagcagtggtggcagtgcacccagctgtgtccatgaatgtggatgctgtgaacatgcagaggatgcagtgctcttgcagtgattgcagagcgcctgcatttccacatatgctggaagcagtgtcccagcaggggttgcagtgccgccttctgtgtccctgaatgtgaatgcagtgcccattgagtggatgctgtgtacctaaagatttatgcagtatgttgtgacggaggatgcagtgcccatgaaggtggatgcagtgtccctgcagtggttgcagtggccatggcattgtcctggagtgtggattcaggggtcatgcagtggatgcagagtgccacagagtggatgcagtatgttgtggcgaaggatgctgtgcacacaaatgtggatacaatgagccggcagtgattgcagtgctcctgcagagtcacttcagcgtcatgcagttttggtgcagtggttgcagacccaactgaagtgtccctgaacgtggatgcagtgcccatgcagtggatgcagtgtaccacaatgtgcatgaagtatgttgtgatggaggatgtattgtccatgaaggtggatgcagtgatcctgcattgcttgcagtgccccccgcagattccataaatgtggacgcactgcccatgcagtggattcagtgccccacaaggtggatgcagtatgttatgacggatgatgcattgcccatgaaggtgcatgcagtgttcctacactggttgtcgtgcctcattatgtgtccctgtttttggaagcagtgcccatcagtggatgcagtgtcccacaaggcagatgcagtatgttgtaatggaggatgcagtgcccatgaaggtggatgtggtgatcttgcagttgttgcagtgcccccttcaggttccctgaatgtggatgcagtgcccatgcagtggatgcagtgtcgcacaaggtggatgtagtatgttgtgatggaagatgcagtgcccacgactgtgaatgcagtgagactgcagtgattgcagtgcgcatgaagtgccacttcaactgtatacagtgtccctgcagtgttccagtgctgcctgcattgtccaggaatgcagatgcactgcccaggcagtggatgcagtgtcacacaagttggatgcagtacattgtgacagaggatgcagtgcccatcaaggtgggtgcagtgatcctgcggtggattctgtgcacactgcagtgtccctgaatgtggatgcagttaacatgaagtggatgctgtaaacattcagtgatggcagtgcacctgcggtgtcacttcagctgcagacagtgtcactgcagtggttgtagtgctgcctgcattgtccatgaatgtggatgcagtgcccaggcagtgtatgcagtgtcacacaagttggatgcagtatgttgtcacagagtatgcagggcccatgaaggtggatgcagagatcctgcagtggtttccatgcacagtgcagtgtccctgattgtggatgcagtgaacaagcagtggatgcaatgaacattcagtgattgcagtgcacctgcagtgccacttcagctgaatgcagtgttgctgcagtggttgcagagaccactgcagtgtctcttaaaatggatgcagggcccatgcagcctctgtagtgtgacccaagttggatgcagtatgttgtgaagtaggatgcagtacccatgaaggaggatgcagtgatcttgcattcattgcagtgcacctggagtgtcaattcgtctggatgcagtgtccctgaatgtggattcagtgctcatgcagtgatgatgtatgttgtgatggaggatgcagtgcccatgcaggcagatgcagtgatcctgcagtggttgcagtgcatctgcagtgccacttcgggtggatctagtgtccctgctggggttgcagtgcctgttgcagtgtccctgaacgtggatgcagtgcccatgcaatggctgcagttcacagaagt

SEQ ID NO: 76 - DNA, 1574 bp, Equus caballus
gcagtggtttcagtgccccctacattttccctgaatgtggatgcagggttcatgcagtggatgcagtgtctcacaaggcggatgcagtatgtattgtcggaggatgcagtgcccatgaaggtggatgcggtgaaccagcagtggtttcagtgccccctacattttccctgaatgtggatgcagggaccatgcagtgtatgcagtgtcccacaaggtggatgcggtatgctgtgaccgaggatgcagtgcacacgaaggaggatgcagtgagactgaagttattgcagtgcacttgcagtgccaattcagctggatgcagtgctgctgcactggtggcagtgcccctgcattgtctgggtatgtgggtgcagtgcccaggcggtggatacagtgtctcacaaggtggttgcagtatgttatgactgatgtttcagttctcatgaaggtggacgtagtgtccctgcagtgcttgtagtgtccccgcattgactgggaatgtggatgcagtagtcatgcagtggatgcagtgttccaaaatgtggatgcagtatgttgtgatggaggatgcagggcccatgaacttgggatgcagtgatgctgtagtggttgccttgcccccctacagttccctgaatgtggttgcagtgcccatgcagtagttgcagtgtcccacaaggtgtatgtcgtatattctgatggaagatacagtgcccacggaggtggatgcagttagcctgtgctgaatgcagtgtgcctgcagtgtgacatcagctgtatgcagtgtctctgcagtggttgcagtgcccactgcattgtccaagaccgtggatgcagtgcccaggaattggatgcagtgtcccctaaggtgcctgcagtatgttgtgatggaggatgcagtgcccatgagggtggatgcagtgatccgacaatggttgcagtgcatgctgctgtgtccctgaatgcatatgctctgaatatggagtggattcagtgatcctgccatgattgcagtgtgcctgcctttccacatcagctgaattcagtgtctctgtaggggttgcagtgccgccttctgtgtccctgaaggtgaatgcagtgcttatgcagtggatgcagtgtatctaaaggtgtatgcagtatgttgtgagggaggatgcagtgggcatgaaggcggaggcagtgtccctccagtggttgcagggcccccagcattgtgctggaatgtggatgtagaggtcgtgcagtggatgcagtgccccagaatgtggatgtggtatgctgtgagagatgatacaaagcccatgaaggtggctgcagtgagcctgaagtgcttgcagagtgcttgcagtgccacttcagctggatgcagtattggtgcaggggtagcagagccaactgcagtgtccctgaacgtggatgcagtccccatacagtggatgcagtgtcccaaaatgtgcatgcagtgtgttgtgatggaggatgcagtggccataaggtggatgcagtgatcctgcagttgttgcagtgccccctgaagcccttcatgagatgtggatgcactgctcatgaagtgg

SEQ ID NO: 77 - DNA, 2810 bp, Equus caballus
ctggctgcagttgcagggcaccctgctctgtccctgaatgtgcatgctctgaacatgcagtggatgcagtgatcctgcagtgattgcactctgcctgtatttacacatcagctggaagccgtgtccctgcaggggttgcactgccaccttttttgtcgctgaaggtgaatgcagtgcccatgcagtggaggcagtgtacctaaaggtttatgtagtatgttgtgacagaggatgcagtgcccatgaagggggaagcagtgtccctccagaggttgcagtgcccccggcattgtcctgaaatgttgatgcagtgcctatgcagttgatgcagagaatcttcagtgaatgcagtgtgcctgcactgccacttcagctggatgcagggtagcttcagtggttgcagagccccatgtcatctccatgaatgtggatgctgtgcccatgcagtgtcagcagtgtgactcaaggtgaatgcagtatgtagtgaagcaggattcagtgcccatgaaggatgatgcagtgcacctgcagtccttgcagtgcacctgcagtgccacttcatctggttgcagtgtccctgtagtggttgcagtgaaccctgctgtttccctgaatgtggatgctgtgaacatgcagtggatgcagtgatcctgcagtgattgcagtgcgcctgcatttcctcatcagctggaagcaatgttgctgcagtggttgcagtgccaccttctgtgtccctgaaggtgaatacagtgcccatgcagtggaggcagtctccctaaaggtttatccactatgttgtaacggaggatccagtgcgcatgaaggtggatgcagtgtccctgcagtggttgcagggcccccggcattgtgctggaattggatgcaggggtcatgcagtggatgcagtgtctctcaaggcggatgcagtatgttttgttggagtatgcagtgcccataaaggtggatgtggagaacctgcagtggttgcagtgctccctacagattccctgaatgtggatgcagtacccatgccatacatgcagtgtccaacaggatggatgcggtatgctgtgacgtatgatgcagtgcccacgaaggtggatgcagtgagcctgaagtgattgtagtgcgcttgcagtgccacttcagctgtatgcattgttgctgcagtggttgcagagcctactgcagtgtccctgaacatggatgcagtccccatgcagtcaatgcagtgtccgacaatgtgcatgcagtatgtcttgatggaggatgcagagcccatgaaggtggatgcagtgatcctgcagtggttgcagtgcccctgcagtttacctaaatgtgcgtgcagtgcccatgcagtggatgcagagtaccaaatgttggttgccgtatgttgtgacagatgatgcagtgtccaggcgttggatgcagtgagccggcagtgatggcactacaccttcagtgtgactacagctggataccctgtccatgcagtggttacaatgaccactgcattgtcctggtatgtggatgcagtgctgatgcaggggatgcagtgtcccacaatgtggacgcattgtggtttgttgtagtatgcagtgccgatgaaggtgaatgcaaggatcctgcagtgattgcagtgagcctgcagtgccgcttcagatggattaagtgatgctgcagtggttacagtgccccctaccgttccagaatgtggatgctgtgcctatgcagtagttgcagtgtcacacaatgtggatgtcatatgttgtgacacatgatgcagtgcccatgagtttgatgcagtgatctggcagtggttgcagtgccaccagcattgtcctggaatgttgatgcagtgccaatgcagtggatgcagtgaaacttccatgattgcagtgcacctgctgtgccacttcatctggatgcagtgtcactgcaatggttgcagtgccccctgcattgtcccttaatgtggatgcagtgcccatgtagtggatccagaatcccaaaatgtccatgcagtatgttgtgacggaggatgcagtgcccatgagggtggatgcagtgatctggcagaggttgccgtgcaccctgctgtgtccctgaatgtggatgctgtgatcatgcagtagatgcagtaatcctgcagtgattgaagtgccgccctatgtgtccctgaaggtgaatgcagtgcccattcagaggatgcagtgtatctaaaggtttacactgtatgttttgacggaggatgcagtgcccatgaaggtggatgcagtgtccctgcagtggttgcagtgccgccgtcattgtcctgtaatgtggaagcaatggtcatgcggtggatgcagtgtctcacaaggccgatgaagtatgttttctcagaggacgcagtgccaatgaaggttgatgcggtgaacgtactgtgggcacagtgccccctacagtttccctgaatgtggatgtggtgcccatgcagtgctggcagagtcccacaagttggatgcagtaagttgtgacggaggatgcaatgctctctaacgcgcatacagggatgctgcgagtgatggaagtgcacctgcagagctacttcatcagttcgcagggatgtagcaggggttgcggagatcatacagcatcgctgaacgcggaagcggtggaccaatcagcggatgcagggacaacggggcgaccgcaggctcgggggatggaggatggggaggccatgtagctgtaggagtggacgctgcgtccctgcaggggcccccggcgctccccctataatttctggtactggcggttgcggagtt

SEQ ID NO: 78 - DNA, 9584 bp, Equus caballus
cccgccaactacacttccggctggctcaatgtgtcctctctgtgttcgcacttctgcctgatttttctgagaaggggaatccagtgccccagcaagtgtacgcattcccacacatagtgggatcgcagtatggtttcacagaggatgcagtgcccatgaagggggatgcagtgatcctgcagtggtttccgtgcacaatgcagtctccctaaatgtggatgcagtgaacaagcagcggatgcactgaatattcactgattgcagtgcaactgcagtgccacttcagctgaatgcagtgttgctgcagtggttgcagagcccccctgcagtgtctctgaatgtggattcagggcccatgcagcctctgcagtgtgacccaagtgggatggagtatgttgtgaagttggatgcagtacccatgaaggaggatgcagtgatcctgcattcattgcagtgcacctggagtgtcaattcatctggatgcagtgtccctgaatgtagattctgtgctcatgctgtgatgatttatgttgtgatggaggattcagtgtccatgaaggcagatgcagtgatcctgcagtgattgcagtgcatctgcagtgccacttcaggtggatccaatgtccctgcagtggtttcagtgcctgttgcactctccctgaacctggatgcagtgcccatgcaatggctgcagtgtcaatgaatgtatatgaagtatgttgtgttggaggaagcagtggccatgaatgtggatgcagtgatcttgcagtggttgcagtgtgcatgcagggccacttcagctggatgcagtgtccctgcagtcgctgcaggacaaccttcactgtcactgaatttgaatgcagtgctcatgcagtgatgaagtatgttgtgatggaggatgcagtgccagtgaaggccgatgcagtgatactgctgtgattgcagtgcgcctgcagtgccacttcagctggatccagagtccctgcagtggttgaagtgcctgttgccctgtgcctgaacgtggctgcagtgcccatgcaatgggtgcagtgtcccacaaggaagatgcagtatgttgtaattgaggatgcagtgcccatgatggtggatgcggtgaacctgcagtggttgcagtgccccctacagtttcccggaatgtggatgcagtgcccatgcagtgcatgcagtgtcccacaaggtggatgcattaagttgtgatggaggatgcagtgctgacgaaggtggatgaagtgagcctgcagtgattgcagtgcacaagcagttccacttcacttggatgcagtgttcctgcagtggtggcaagccaactgcattgtccgagaacatggatgctgtgcccatggagtggatgcagtgtcaaacaatgtgcatgcagtatgttgtgatggagtatgaaatgcccattatggtggacacaggctccctgcagtggttgcagtcacccctgctttgtctgagaatgtggaagcaatgctcaggcagtggatgcagtgtcccacaagagggatgccttatgttgtgctggaggattcagtgaccatgaaggaggatgcagtgatcctgcagtcatggcagtgcacctgcagtgcaacttcagctggctgcagtgtcatttcagtggttgcagtgccccgttctgtgtccctgaatgtgtatgcattgctcatgcagtggatgaagtgtcccacaatttggaggcattgtgatgtgttctagtatgcagtgccaatgaaggtgaatgcagtgatggcagtgcacctgcagtgccaattcagctggatgcagtgttgctgcagtggttgctatgcccacttcattgtccgggaatgtggatgcagtgcccaggcagcggatgcagtgtcccacaaggtggatgcagtatgttgtgctggaggatgcagggcccatgaaggtggatgcagtgatgctgcagtggttgcagtgccccctacagttccctgaatgtggatgcagtgcccatgcagtagttgcagtgtgttacaaggtggatgtcgtatgttgtgattgaagatgcagtgcccacaaaggtggatgaagaatcctgtgctgaatgcagtcagcctacagtgtgacttcctctgattgcagtgtccctgcagtggttgcattgcccattgcattgtcagagaacgtgtatgcagtgaccagcattggatgcagtgtcccgcaaggttcatgcagtatgttgtgacagaggctgcagtgcccatgaaggtggatgcagtgaacgtgcagtggttgcagtcccccctatattttccctgaatgttgatgcagtgcccatgcagtgcatgctgtgtcccacaagttggatgcagtatgttgtgacggagtatgcagtgtccgtgagggtggaagcagtgatccggcaatggttgcagtgcaccctgctgattccctgaatgtggatgctgtgaacattagtggatgcagtgatcctgcagtgatggcagtgtgccttcatttacaaatcagctggaaggagtgtcactgcagtggttgtagtaccgccttctgtgtccctgaagcttaatgcagtgccaatgccatggatgcagtgtacataaaggtttatgaaggaagttgtgacggaggatgcagtgcccatgaaggtggatgcagtgtactggcagttgttgcagtgcccccggcactgtcctggaatggggatgcagtggtcctgcagtggatgcagtgtccatcaatgtggatgacttatgttgtgatggatgattgagtaatcatgaaggaggatgcagtgatactgcagtgatggcagtgtgcctgcagtgtctggcattgtggatgaagtgcccaggcagtggatgcagtgtccctcaaggtggatgaagtatagtatgacggatgatgcaattcacatgaaggtggatacagtgtccctgcagtgcttgcagagcccacacattgtccgggaatgtggatgcagtgctcatgcagtggatgcagtgtccctcaaggtggatgccttatgatgtgttggaggattcagtgatcatgaaggaggatgcagtgatcctgaagtcattgcactgaacttgcagtgccacttcagctggctgcagtgtccctgcagtggtgtcagtgccccgtcctgtgtccctgaatgtggatgcagtgcccatgcagtggatgcagagtaccaaaagttggtctccgtatgttgggacagagtatgcagagccctggagttggatgcagtgagccagcagtgattgcagtatgcctttagtgccacttcagctggatgcagtttccctgcagtggttgcaattccccctgcattgtcctgaaatgtggatgcagtgctcgtgcagtggatgcagtgccccacaatgtggaggcattgtggtatgttgtagtatgcaatgcagatgaaggtgaatgcagtgattctgcagtgatggcagtttgcctgcagtgctccttcaactggatgaagtgtccctgcagtggttgcagtgccccctgcattgtcctgaaatgtggatgcagtgcccagtcagtggatgcagtgtcccacaatgtgcatgcagtatgatgtgacggaggatgcagtgctaatgaaggtgcatgcagtgatcctgcagtggttgcagtgccccctgcagtttaccttcatgtggatgcagtggtcatgcagtgcatacagtgtcccacaagttggatgccttatgttgtgatggaggtttcagtgatcatgaaggaggatgcatcgatacagcagtcattgcagtgcatctacagtgccacttcagctggctgcagtgtcactgcagtgcttgcaatgccacgttctgtgtccctgagtgtggatgcagtgcccatgcagtggatgcagagtaccaaaagttggttgccgtatgttgtgacagaggatgcagtgcgcacgagttggatgaagtgagctgacagtggttgcagtacgcctttagagccacttcagctggattcagtgtccttgcagtggttgtgatgccccctgcattgacctggaatgtggatgcagtgctcatgcagtggatgcagtgtcccgcaatgtggaggcattgtggtgtgttgtagtatgcagtgctgaagaaggtgaacacagtggtcctgcagagatggcagtgcacctgcagtgccacttcagctggatgacgtgtccctacagtgcttgctgtgccacccacattgtgtgggaatgtggaagcgctagtcatgcagtatatgcattgtcccacaaggtggatgcagtatgttgtgatggaggatgcaggggccatgaatgtggtgcagtgatgctgcagtgtttgcactgtcccatacagttccctgaatgtggaggcagtgcccatgtagtgcatgcagtgtaccacaaggtggatgtgacatgttgtgaaggaggatgcagtgcccacaaaggtggatgcagtgatcctgcagtgattgcactgcacctgcagtgccacttcagctggatgcggtgttgcttcactggtagcagagccaactgcagtgtcctttaacatggattcagtgcacatgcagtggatgtagtgtcccacaatgtgcatgaagtatgatgtgacggaggatgcagtgctaatgagggtggatgcagtgatcctgcagtagttgcagtgccccctgcactttacctgcgtgtggatacagtggtcgtgcagtggatgcagtgtccttcatggtggatgccttctgttgtgatagtggattcagtgatcatgaaggaggatacagtgatcctgcagtcattgcagtgcacctgcagtgtcacatcagctggctgcagtgtccctgcagtgtttgcagtgccccgttctgtgtccctgagtgtggatgcagtgcccatgcagtggatgcaaagtaccacaagttgtttgccgtatgttgtaacagaggatgcagtgcccacgaattgaatgcagtgagccagcagtgattgcagtacacattcagtgccagttcagttggatgcagtgtccctgcagtggttgcgatgccccctgcattgacccggtatgtggattcagtgcccaggcagtccatctagtgtcccacaaggtgcatgcagtatgttgtgatggaggatgcagcacccatgacggtcgatgcagtgatgctgcagtggttgctgtgccccgtacagttccctgaatgtggatacagtgttgctgaagtgcttgcagtgcccccggcattgtccgggaatgtggatgcagtagtcatgcagtggatgcactgtcccacaaggtggatgcagtatgtcgtgatggaggatgcagtgcccacgacggtacatgcagtgagcttgcactgattgcagtgcacttgcagtgacacttcagctggatgcagtccttctgcagtggttgcagagccaacagcagtgtccctgaacgtggatgcagtgcctatgcagtggattcagtgtctcacaaggcagatgcagtatgtttggtcggaggatgcagttcccatgaaggtggatgcggtgaacctgctgtggttgcagtgccacctgcactttaccacaatttggatgtagtgctcatgcagaggatgctgtatcccacaatgtggatgtcgtatgttgtgatggaagatgcagtgcccacgaaggtggatgcattgagccggcagtgaatacagtgcacctgcagtgcgacttcagctgtatgcagtgtcccagcagtggttgcagtgcgcactgcattgtgcaacaacgtggatgcagtgcccagacattggatgcagtgtcccacaaggtgcatgcagtatgatctatcggaggacacagtgcccatgaaggtggattcagtgatccggcagtggttgcagtgcatcctgctgtgtccctgaatgtgggtgctgtgaacatgcagaggatgcagtgatcgcagtgcacctgaatttcaacatcagctggaagccttgtgtagaaggggttgcagtgccaccttctgtgtccctgaaggtgaatgcagtgcccattcagtggatgcagagtcccacaatgtgcatgccgcatgtctggctggaagatgcagtgctaatgaatgtggatgcagtgatcatgcagtggttgcagggtcccaggcattgtgctggaatgtggatgcagggttcatgcagtggatgaagatctcacaaggcaatgcagtatgttttgtcagaggatccagtactcatgaaggtggctgcagtggtcctgcagtggttggcagtgcccccctacagtttctctgaatgtggatgcagtgggcatgcagtgcatggagtatcccacaaggtggatgcggtatgctgtgacagaggatgcagtgcccacgaaggtgcatgaagtgagaataaagtgattgcagtgtgcttccagtgccacttcagctggatgcagttttgctgcagtgtttgcagagccaactgcagtgcccctgaacttggatgatgtccccatgcagtggatgcagtgtcccaaaatgtgcatgaagtatgtcgtgacggaggatgcagtgcccatgaaggtggatgcagtaatgctgcagtggttgcagagccccttgcagtttacctgaatttggatacagtgctcatgcagtgggtgcaatgtcccgcaaaggtggatgccttatgatgtgttggagaattcagtgatcgtgaaggaggatgcagtgatcctgcagtcattgcagtgaacttgcagtgccacttcagctttgtgcagtgtccctgcagtggttgcagtgccacgtcctgtgtccctgaatgtggaaacagtgcccatgaagtggatgaagagtaccaaaagtgggtggaggtatgttgtgagagaggatgcagaggcctggagttggacgcagtgagccggcagtgattgcagtacgccttcagtgccacttcagctgcatgcagggtccctgcagtggtggcaataccccctgcatttgtcctggaatgtggatagagtcctcatgcagtggatgcagtgtcccacaatgtggaggcattgtggtgtgttgtaggatgcagtgccaatgaaggtaaatgcagtgatcctgcagtgattgcagtacgccttcagtgccacttcagctgcatgcagggtccctgcagtggtggcaatgccccctgcattgtcctggaatgtggatagagtgctcatgcagtggatgccgtgtcccacaatgtggaggcattgtggtgtgttgtaggatgcagtgccaatgaaggtgaatgcagtgatcctgcagtgatggcagtgcacctgctgtgccacttcagctggatgcagtgttgctgcagttgttgcaatgcacccagcattgtccaggaatgtggatgcagtggccagtcagtggatgcagtgtcccgcaaggtgtatgcagtatgttatgacggatgatgcagttctaatgtaggtgaattcagtgtccctgcagtggttgcagtgacccctgcattgtctgggaatgtggatgcagtagtcatgcagtggatgcagtgtcccacaaggtggatgcagtatgttgtgatggagaatacagggcccatgaaggtggatgcagtgatgctgcagtggttgaggtgccacctacagttccctgaatgtggatgcagtgcccatgcagtagatgcagtgtcccacatggtgcatgtcgtatgttgtgagggaagatgcagtgtccacgaaggtggatgcagcgagcctgtgctgaatgcagagcaccagctgtgtgacttcaactgtatgcagtgtccctgcagtggttgcagtgccgaatgcattgtctgagaacgtggatgcagtgcccaggcattggatgcagtgtcccacaaggtgcatgcagtatgtggtgacggaggtagcagtgcccatgagggtggatgcagtgatcagggagtggttgcagtgcaccctgctgtgtccttgaatgtgcgtgctctgaacatgcactggacgcagtgatcctgcagtgattgcagtgtgcctgcatttccacatcaactggaaccaatgtccctgcaggggttgcagtgctgccttctgtgtccctgaatttgaatgcagtgcccatgcagtggacgcagtgtccctaaaggtttatgcagtatgttctgatggaggatgcagtgcgcatgaaggcagacgcagtatcccggaattggtttcagggcccccggcattgtgctggtatttggatgcaggtgtcatacagtggatgcagtgtctcacaaggcggatgcagtatgttttgtcggaggatgcagtacccactaaggtggatgcggtgaacctgcagtggttgcagtgcaccctaaagttccctgaatgtggatgcagtggccatgcagtgtatgcagtgtcccaccaggtggatgtggtatgctgtgacggaggatgcagtgcccaggaaggtggaggcagtgagcctgaagtgattgcagtgtgcttgcagtgccacttcagctggatgcagtgttgctgcaatggttgcagagccaaatgcagtgtccctgaacgtggatgcagtccccatgcagtggatgcagtgtcccataatgtgcatgcagtatgtcgttacggaggttgcagtgctcatgaaggtggatgcagtgacactgcagtggtttcagtgtcccctgcagtttacctgaatttggatgcagtgctcatgcagtggatgcagtgtccctcaaggtggatgccatatgatgtgttggaggattcagtgatcatgaaggaggatgcagtgatcctgcagtcattgcaatcaagttgcagtgccacttcagctgactgcagtatcccttccatagttgcagtgccccatcctgtgtccctgaatgtggatgcagtgcccatgtagtggatgcagagtaccaaaagttcgctgctgtatgttgtgacagaggatgcagagccctggagttggatgcagtgatctggcagtgattgcagtacgactttagtgccacttcaggtggatgcagtgtccctgcagtgcttgcagttctcccagaattgtccgggaatatggatgcagtagtcatgcagtgcatgcagtgtcccacaaggtggatgcagtatattgtgatggaggatgcaaggctcatgaaggtggatgcagtgatgctgaagtggttgcagtgccccttacagttccctgaatgtacgtgcagtgcccatgcagtacttgccgtgtcccacaaggtggatgtcatatgttgtgatggaagatgcagtgcccgtgggggtggatgcagtgagtctgtgctgaatgcagtgcacatgcagtgcgacttctgttgtatgcagtgttgctacagtcgttgcagggcacccgtgaattgtccaaagatgtggatgcagtgcccatccagtgtatgcagagaaccattaagttgatttgccgcatcgttgttgaagcaggaagcagatctccgagagatactatgcagagatttgcagaggttgccgggacactgttatcggcctcaccatctaatcaagtgcacctgca

SEQ ID NO: 79 - DNA, 2209 bp, Equus caballus
ccaagccacccctgcgtgtctcctgaaatgtacatgtttgagaacaagcaggggatgccagtgatcctgcaagtgattgcagtgccacttccattaccacattcaggatggaagaatgtgtccctgcaggtgttccagtggtttctttctgtgtcgctgaagggtgaaatgcactcccatgccagtggatgcaggatacgttaaggttttatgcagtattttgtgagggaggatgcagtgccaatgaaggggggatgcagtgtccctgcagtattttgcagtgctgccagcattgtcctgaaaatgttgatgcagtgcctatttcagtggaatgcagtgcacctgcagcgccacttcagctagatgcagtgtccctccagtggttgcagtgcctcatctcgtgtcacctaatgtggatgcagtgcccatgcagtggatgcagagtaccaaaagttgtttgccgtatgttttgacagaggatgcagtgaccaccagttggatgcagtgagccgggagtgattgcagtacgccttcagtgtcacttcaactggatgtagtgcccctgcagtggttgcaatgccccctgtattcttctggaatgtggattcagtcctcatgcactggatgcagtgtcccacaatgtgcaggcattgtgttgtgttgaagtacgcagtgctgatgaaggtgaatgcagtgatcctgcagtgatggcagtgagactgcagtgacacttcagctggatgcagtgttgctgcagttcttgcagtgctccctgcattgtccagcaatgtggatacagtccgcaggcagaggatgcagtgtcccacaaggtggatgcagtatgtaattacagatgatgcagttctcatgaaggtgaaggcagtctccctgcagtgcttgaagtgccccccgcattgtccgggaatgtggatgcagtagtcatgcaatggatgcagtgttccacaaggtggatgcagtatgttgtgacggaggatgcatggcccatgaaggtggatgcagtgcccctgcagtagttacagtgtctcacaaggtggatgtcgtatgttctgatggaagatgcagcacccacgaaggtggatgcagtgagcctgtgctgaatgcagtcgcctacagtgcgacttaagctgtatgcagtgtcccttcagtggttgcagtgtccactgcattgtccaagaacgtggatgcagtgcccaggcattggatgcagtgacccacaagctgcaggaggtatgttgtgatggaggatgcggtgcccatgagggtgaatgcagtgatctggcagtggttgcagtgcaccctgctgtgtccctgaatgtgcatgctctgaacatgcagcggatgcaatgatcctgcagtgattgcagtgcagctgcatttcctcatcagctggaagcagtattgctggagtggttgcagcgccgccttctgtgtccctgaaggtgaatgcagtgcccatgcagtggaggcagtgtacctaaaggttatgcgttatgttgtgacggagaatgcagtgcccatgaagggggatgcagtgtccctccagtggttgcagtgtcccctgcattgtcctgaaatgttgatgcagcgcctaagcagtggatgcagtgaatcttcagtgattgcagtgcacctgctgtgccatttcagctggatgcagtgtagcgcagtggttgcagagccccatgccatctccctgaatgtggatgctgtgtccatgtagggtccaccgtgtgactcaaggtgtatgcagtatgttgtgaagtaggattcactgcccatgaaggacgatgcggtgatcctgcagtcattgcagtgcttctgaagtgccacttcagctggatgctttgtccctgcagtggtttcacagccccgtgcattgtcctggaatgtagatgcagtgctcatgcagtggatacagtgtcccacaacgtggaggcattgtggtgtgttgaaatatgcagtgccgatgaaggtgaatgcagtgatcctgcagtgatagcagggagcctgcagtgccacttcagctggatgcaatgttgctgcagtggttcctgtgccccctgcattgttcgggaatgtggatgcagtgcccaggcagtggatgcagtgtccgacaagttggatgcagtatgttatgatggaagaggcagttctcatgaaggtggatgcagtgtccctgcagtgctgc

SEQ ID NO: 80 - DNA, 27756 bp, Equus caballus
atgcagtgcccaatggttggactgtggtgatcctgcagttggttcgcagcgccccctacattttccccagaatggtggatgcagtgccccatgcagtgcatgcggtgtcccacaaggtgaattctctatgctgtgacggaggatgcagtgcacacgaaggtagatgcagtgagcttgaactgattgcagtgccacttcacctggatgcagtgttcctgcagtggttgcagagccaactgcagtgtccctgaatgtggatgcagtgcctatgcagtggatgcagtgtcccacaatgtacatgcagtatgttgtgacagaggatgcagtgcccatgagggtggatgcagtgatcctgcagcggttgcagtgccccctgcagtttacctgaatgtggatgcagtgctcatgcagtggatacagtgtgccttaatgtggatgccttatgacgtgttggaggattcaatgatcatgaaggatgatgcagtgatcctgcagtcattgctgtgaacttgcaggggcacttcagctggctgcagcgtccctgcagtggatgcagtgccccgtcctctgtcgctgaatgtggatgcagtgcccatgcagtggatgcagagtacaaaagtttggttgctgcatgttgtgacagaggatgcagagccctggagctggatgcagtgagacagcagtgattgcagtgcaccttcagtgccacttcagctggatgcagtgtccctgcgggggttgcagtaccacctcagtgtcactgaaggtgaatgcagtgtccatgcagtgtatgcagtgtacataaatgtttatgcaatatgttgtgacggaggatgcagtgcccatgaaggggcatgcagtgtccctgcagtggtggcagtgcccccggcattgtcctgaaatgttgatgcagtgcctatggagtggatgcagtgaatcttcagttaatgcagtgcacctgcatttccacatcagctggaagcggtgtccctgcaggggttgctgtaccgccttctgtgtcactgaaggtgaatgcagtgcccattaaagtggatgcagtgtcactgcattggttgcagtgcccccagcattgtcctggaatgtggatgcatgggtcatgcagtggatgcagtgtctcagaacacggaagtagtatgatttgtcagaggatctaatgcccatgaaggtggatgccttgaacctgcagtggctgcagtgccccctacagtttccctgaatatggatgaagtgcccatgcagtacacgcagtgtcccacaaggtggatgcagtaggttttgatggaggatgcagtgcccatgaaggtggatgcagggatgctgcagtggttgcagtgcccctacagttccctgaatgtggatgcagtgtccatgcagtagttactgtgtgccacaaggtgtatctcgtgtattgtgatggaagatgcagtgccagcaaaggtgtatgcagtgagcatgcagtgattacagcatgcattcaatgccacttcagatgtagtcagtgtccctgcagtggttgcagtgccccccgcattgtccaggaatgtggatgcagtgtatgcactgtacctgaatgtggatgcagtatgttgtgatggaggatgcagggcccatgaaggtggatgcagtgatgctgcagtggatgcagtgccccatacagttccctgaatgttgattcagtgcccatgtatgagatgcagtgtccaacaaggtgtatgtcgtatgtttgatggaagatgcagcaccctcgtaggcagatgcggtgatcctgtgctgaatgcagtgcacctgcagtgcgacttcatctgtatgcagtgtccctgcagtggttgcagtgctgactgcatcatccgagaacgtggatgcagtgcccaggcattggatgcagtgtcccacaggtgcatgcagtatgttgtgacggaggatgcagtgcccatgtgggtggatgcagtgatctggcagtggttgcagtgcatccgcatttccaaatcagctgcaagcagtgtccctgcaggggttgcagttccaacttttttgtccctgaagctgaatgcactgcccatgcagtggatgcagtgtacctaacggtttatgcagtatgttgtgatgtaggatgcagtgcccatgatggggaaggttgcagtgtccctccactggtagcagtgcccccggcattgtcctgaaatgttgatgcagtgcctatgcagtggatgcagtgtatcttcagtgattgcagtgcacctgcagtgccacttcagctgaatgcagtgtagctgcagtggttgcagagccccctgccatgtccctgaatgtggattctctacccatgcagtgtctgcagtgtctcacaaggcagatgaaatatgtcttgtcggaggatgcagtgcccatgaatgtggattcggtgaaactgcagtggtgacagtgccccctacagtttccctgaatgtgcatgcagtgcccatgcagtgcatgcattgacccacaaggtggatgcagtatgttgtgatggaggatgccgtgccaacgaagatggatgcagtgtcacacaatttggagtcattgttgtgtgttgtagtatgaagtgccgatgaaggtgaatgcagttatcctgcactgatggcagtgcgcctgcagtgccacttcacccatatgcagtgctgctgcaatgattgcagtgcccgctgcattgccaggaatgcggaagcagtgcccaggcagtggataaagtgtccctcaaggtggatgcagtatgttatggcagatgatgcagttctcatgaaggtgaatgaagtgtccctgcagtgctttcagtgcccccccattgtccgggaatgtggatgcagtagtcatgcagtggatgcagtgtcccacaaggtgcatgcagtatgttgtgacggaaaatgcagtgcccatgaacgtggatgcagtggacctgcagtgcttgctgtgcccccggcattgtccaggaatgtggaagcagtggatgcactgtcactcaagttggatgccgtatgttgtgatggaggatgcagggcccatgaaggtggatgtagtgatgctgcagtggttgcagtgccccctacagttccctgaatgtggatgtagtgcccatgcagtggatgcagagtaccaaaatttggttgccatatgttgtgacagaggatgcagtgcccacgagttggatgcagtgagccagcatagattgcagtatgccttcagtgccacttcagctggatgcagtgtccctgcagtggttgcaatgccccctgcattttcctggaatgtggatgcagtgctcatgcagtggatgcagtgttccacgcgatggatgccttatattgtgacggaggattcagtgatcatgaaggaggatgctgtgatcctgcagtcattgcagtgcacaggcagtgccacttcagctggatccagtgtccctgtagtggttgcagtgtccacttcattgtccgagagcttggatgtagtgtccagccattggatgctgtgtcccacaaggggcatgcagtatgctgtgttggaggatgctgtgcccatgaaggtgggtgcactgatccagcagtggttacagtgcacgctgctgtgtcctgaatgtggatgctgtgaacatgcagtggatgcagtgatcctgcagtgattgcagtgccgcctcatttccacatcagcaggaagcagtgtgcctgcaggggtttcagtgccaccttctgtgtccctgaaggtgaatgcagtccccctgcagtggatgcagtgaacctaaaggtttatccagtaggttgtgagggaggatgcagtgcccatgaaggtggatgcagtgtccctgcagtggttgcagtgccaccggcattgtcctggaatgtggatgcagtagtcatgcagtggatgcagtgtcccatgaggtagatgcagtatgttgtgatggaggatgcagggcccatgaaggtggattcagtgatgttgcagtggttgctgtgccccctgcagttccctgaatgaggatgcagagcccaacagtagttgcattgtccctcatggtggatgtcgtatgttctgatggaagatgcagtgcccacgaaggtgaatgccgtgagcctgtgctgaatgcagtgtgcctgcagttcgactttagctgtatgcagtgtctctgcagtggtttcagtctccactgcattatccgagagcgtggctgcagtgcccaggcattggatgcagtgtcccacaaggtgcatgctgtatgttgtaatggaggatgcagtgcagatgaaggtggatgcagagtactaaaagttggttgctgtatgttgtgacagaggatgcagtgcccctgtgttggatgcagtgagccggcagtgattgcatacgccttcagtgccacttcagctggatgcagtgttgctgcagtggttgcagatgcaactgaggtgtcccagaacgtaaatacagtgcccaaagagtggattcagtgtcccataatgtgcatgaagtatgttgtaacggaggatgcagtgcccatgaaggtggatgcagtgagagggtgctaaatgcagtgcacctgcagtgcgatttcatctgtatgcagtgtccctgctgtagttgcagttcccactgcattgtccgagaacgtggatgcagttcccaggcattacattcagtgtcccacaaggtggatgtggtatgctgtgacagaagattcagagcacacgaagctggatgcagtgagcctgcagtgagtgcagtgtgcctgcagtgccacctcagctggatgccgtgttgctgctgtggctgcagaggcaaatgcagtgtccctgatcatggatgcagtgcccatgcagtggatgcagtgtcccacaatttgcgtgcagtatgttgtgatggagaatgcagggcccatgaaggtggatgcactggtcctgcactggttggagtgccccctgcagttcactgactgtggatgcagtgcccatgcagtagttgcagtgtgccacaagttggatgtcgtatgttgtgatggaagatgcagtgcccacgaagggggttgcaatgagcctgtgctgaatgcagtgcacctgcagtgcgacttcagctgtatgcagtgtccctggagtggtgctgtgcccattgcattgttcgataacgtggattctgtgcgcaggcattggatgtagtgtcccacaaggtgcatgcagtatgttgggacaaaggatgcagttcccatgaaggtggattcagtgtcccagcagtggttgcagtgcccctggcattatacttgaatgcggatgctggagtcatgcagtggatgcagtgactcaaaaggcggatgaagtatgttttgtcagaggatgcagtgccaatgaaggtagatgcggtgaatctgcagtggttgcagtgcccactacaatttccctgaatgtggatgcagagctcatgcagtgcatgcagtgttccacgagttggatgcagtatgttctgatggaggatgcattgcccacgaaggttgatgcagtgaccctgaattgattgaagtgcgcttgcagtgccacttcagctggatgctgtgatcctgcagtggttgcagtgccccctgtagtttaccttaatgtggattcagtgctcatgcagtggatgcagtgtccctcaaggtggatgccttatgatgtgttggagaattcagtgattatgaaagaggatgcagtaatactgcagtcattgcagtgaatttgcagtgccacttcagcggtctgcagtgtccccacagtggttgcattgccgcatcctgtgtccctgaatgtggatgcagtgcccatgcagtggatgcagagtaccaaaaattgactgccgtatgttgtgacagaggatgcagagccctggagttggatgcactgagccgacagtgattccagtatgccctcaatgccacttcagctggatgcagtgtccctgcagtggttgcagtgatccatgcattgtctgggaatgtggatgcagagctcatggagtggatgcagtttcccacaatgtggagtcattttgttgtgttgtaggatgcagtgctgatgaagttgaatgcagtgatcttgcaatgatggcagtgtgactgcagtgccacttcagctggatgcagtgttgctgcagtgcttgcagtgccccctgcattgtccgggaatgtggatgcagtgcccaggcagtggatgcagtgtcccacaaggtggatgctgtatgttgtgatggaggatgcagggcccatgaagtggatggagtgatgctgcagtggttgcagtgccccctaaagttccctgaatgtggatgcagtgcccatgcagtagttgcagtttcccacaaggtggatgttatatgttgtgatggaagatgcagcgcccacggaggtggatgcagtgatcctatgctgaatgcagtgcacctgcattgcaactttagctgtatgcagtgtccctgcagtggtttcagtgcacactgcattgtccgagaacgtggatgcagtgcccaggcattggatgcagtgtcccacaaggtgcatgtggtatgttgtgacggaggatgcagtgcccatgagggtggatgcagtgatccggcagtgcttgcagtgcaccctgctgtgtccctgaatgtgcatgctctgaacatgcaatggatgcagtgatcctgcagtgattgcagcgcatctgcatttccacatcagctggaagcagtgtccctgaagggcttgcaattccaccttctgtgttgctgaatgtgaatgcagtgcccatgcagtggatgcagtgtcctttaaggcttatacagaacgttgtgacggaggatgcagtgcccatgaagagggatgtagtgtccctcctgtggttgcagtgcccccggcattgttctgaaatggtgatgcagtgcctatgcagtggatgcagtgaatctttaatgattgcagtgcacctgcagtgccacttcagctggatgcagtgtccctgaacgtggatgcagtgcccaatcagtggatgcagtgtcacactatttgcatgcagtatgatgtgacagaggatgcaatgccaatgaaggtggatgcagtggtcatgcagtggatgcagtgtccctcaaggtgggtgcattatgttgtgatggaggattcagtgatcatgaagaatgatgcagtgatcctgcagtcattgcagtgaacctgcggtgccacttcaggtggctgctgggtccctgcagtgctttcagtgccccatcctgtgtccctgagtttggatgcagtgcccatgcagtggctgcatagtaccaaaagtttgttgccgtatgttgtaacagaggatgtagtgaccacgtgttggatgcagtgagccggcagtgattgcagtacaccatcagtgccacttcagctggatgcagtgtccgtgcagtggttgtgatgccccctacattgtcctggaatgtggatgcagtgctcatgcagtggatgcagtgtcccacaatgtggaggcattgtggtatgttgtagtatgccatgctaatgaaggtgaatgcagtgatcctgcagtgatggcagtgcacctgcagtgccaattcagctggatgcagtgttgctgcagtggttgcagtgccccctgcatagtcagggaatgtggatccagtgcccatgcattggatgcagagtcccccaaggtggatgcagtatgtgatgacagatgaggctgttctcatgaaggtggatgcagtgtcactgtagcgcttgcagtccccccactttgtctggtaatgtggatgtagtagtcatgcagtggatgcagtgtcccacaagttgtatgcagtatgttgtgatggaagatgaattgcccacatatgtggatgaagtgagcctctgctgaatgcagtgtgcctgcagtgcgacttcagctgtatgcagtgtccctgcagtggttgcagtgcccactgcagtgtccaagatcgtggacgcagtgcccaggcattggatgcagtgtcgcactatgtgcatgcagtaggttgtgacggaagatgcagtgcccatgaaggtggatgcagtgatcctgcagttgttgcagtgcaccctgctgtgtccctgaatgtggatgctgtgaacatgcagtggatgaagtgatcctgcactgattgcagtgcacctgcatttcctcatcagctggaagcagtttccctgctggggttgcagtgctgccttctgtgtccctgaaggtgaatgcagtgcccatgcagtggatgcagtgtacctaaatctttatgcagtatgttgtgacggaggatgcagtgcccatgaaggtggatgcagtgtccctgcagtggttgcagtgtcccattctgtgtccctgaatgtggatgcagtgcccatggtgaggctgcagagtaccaaaattcggttgccatatgttgtgacagaggatgcagtgcctgactgttggatgcagtgacccagtgctgaatgcagtgtacatgcagtgcgacatcacttgtgtgcagtgttcttgaagtggttgcaattccccctgcattgttggaatgtggatgtagtgctcatgcagtggatgcaatgtccggcaatgtggaggcattgcactgtgtttcagtatgcagtgcctgtgaagcttaatgcactgatcctgcagtgatggcactgtacctgcagtaccacttcagctggattcagtgttgctgcagtggttgctgagccaactgcagtgtcccataacgtggatgcagtgctcaggcagtggatgcagtgtcccacaaggaagatgcagtatgttatgatggatgatgcagttttcatcaacgtggatgcagtgtcgctgcggtgattgcagtaccgctggcattgtcctgcaacgtggatgcagtgcccaggcagtggatgcagtgtcccacaatgtgcatggcgtatgttttgacgtaaaatgcagtgcacatgaacgtagatgcagtgatccttcagtgcttgcaatgccccctgcagtttacctgaatgtggatgcagtgctcatgcagtggatgcagtgtccctcaatttggctggcttatgttgtgatggaggattcagtgatcatgaaggaggatgctgtgattctgtagtcattgtagtgctccttcagtgccacttcagttggctgcagtgtccctgcagtggttgcagtgcactgttctatgtccctgaatgcggatacagtgcccatgccgtgcattcccacaatgtggatgcggtatgctgtgatggaggatgcagtgcccacaaaggtggatgcagtgtccctgcagtgcttgcactgcctcccgcattgtccgggaatgtggatgcagtagtcatgcagtggatgcagtgtcccataatgtgcatgcagtatgttgtgacggaggatgcagagcactggagttggatgcagtgagctggcagtgattgcagtacgccttcaatgccacttgagctggatgcagtgtccctgcaggggttgcaatgccctgtgcattgtcctggaatgtggatgcagtgctcatgcagtggatgaagagtcccacaatgtggaggcattgtggtgtgttgtagtatgcagtggcaatgaaggtgaatgcagtgatcctatagtgatggcagtgcgcctgcagtgagacttcagctggatgcggtgaacctgcagtggttgcagtgccccctacagcttccctgaatgtggatgcagtgcatatgcagtgcattcagtgtcccacaatgtggatgcggtatgctgtgatggaggaggcagtgcccacaaaggtggatgcagtgtccctgcagtgcttgcactgccccccgcattgtccgggaatgtggatgcagtagtcatgcagtggatgcagtgtcccataatgtgcatgcagtatgttgtgacggaggatgcagcgcccatgaaggtgtatgtgctgatcctgcactggttgcactgccccctgcagtttacctgaatgtggatgcagtgctcatgcagtggatcctgcagtcattgcagtcaacctgcagtgccaattcagctggcttcagtgttcctgcagtggttgcagtgccccgttctgtgtccctgagtgtggatgcagtgcccatgcagtagttgcagtgtcccataaggtggatgtcatatgttgtgatggaagatgcagtgcccacaaaggtggatgcagtgagccttcagtcattgcagtacaccttcactgccacttcagctgtttgcagtgtccttgcagtggttgcagttcccccttcggtgtcccagaatgtggatgcagtgcccatgcagtggatgaagagtaccaaatgttggttgccatttgttgtgatagaggatgcacagccctgaagttggatgcagtgagccagcagtgattgcagtacgccttcagtgccaattcagctgcatgcagtgtcgctgcagtggttgcaataccccctgtattgtcctggaatgtggatgcagtgctcatgcagtggatgcagtgtcccacaatgtggaggcattgtggtgtgttgtagtatgcagttccgatgaaggtgaatgcagtgatcctgcagtgatggcagtgcgcatgcactgtgacttcagctgtatgctgtgtccctgtaggcgttgaagtgctgccttctgtgttcctgaaggtgaatgcagtgcccatgcagtgggtgcagtgtacctaatggtttatgcagaatgatgtgacagaggatgcagtgcccatgaaggtggatgcagtgtccctgcagtggtggcagtgtcctggggattgtcctggaaagtggatccagggttcgtgcagtagatgcagtgtgtcataaggcagatgcagtatgctttatcaaaggatgccatgcccatgaaggtggattcggtgaacctgtagtggttgcagtgccacctacagtttccctgaatgtggatgcagtgcccatgcagtgcatgcaatgtctcacaaggtggataccgtatgttgtgacggaggatgctgtgcccacgaaggtggatgcagtgagactgcagtgattgcagtgcacctgcagtgccacttcagctggatgcagtgttgctgcagtggttggagagccaactgcagtgtccctaattgtggatgcagtgcccatgcagtggatgcagtgtcccctaatgtgcatgcggtatgtggtgacggaggatgcagtgctcatgaaggtggatgcagtgatcttgcggtcaatgccatgcccatgcagtgccacggcagttggctaaagtgtcccttccgtgtttgcagtgccctttctgtgtccctgaatgtggatgcagtgcccatgcagtgcatacagagtaccaaaagttggttgccgtatgttgtgacagaagatgaagtccccacgagttggatgcagtgaaccggcagtgactgcagtacacctccagtgacacctcagctggatgcagtgtccctgcagtggttgcaatgccccctgcattgtcctggaacgtggatgtggtgctcatgcagtggattcagagttccacaatgtggagacattgtgttgtgttgtagtatgcagtgccgatgaaggtgaatgcggtgatcctgcagtgatggaagtgagcctgcagtgccatctccactggatgcagtgttgctgcagtggttgcagtgccccctgcattctccaggaatgtggatgcagtgcccaggcagtggatgcagtgtcccacaaggtggatgcagtatgttatgacacatgatgccgttctcatgaaggtggatgcagtgtccctgcagtggatgcagggctccccgcattttccaggaatgttgatgcaggagtgatgcagtggatgcagtgtcccacaatgtggatgcagtatgttgtgatggaagatgcagggcccatgaaggtgaatgcagtgatgctgcagtggttgcagtgcacccaacagttagctgtatgtggatgcagtgcccatgcagtagttgcagtgtcccacaattggatgtcgtatgttgtgatggaagatgcagtgctgacgaaggtggattcagtgagcctgcagtgattgcagtgcacctgcagtgcgacttcagctgtatacagggtccctgcagtggttgaagtgccaactgcattgtccgagaacgtggatgcagtgccctgcattggatgcagtgttccacaaggtggatgctgtatgttgtgtcggagtattcagtgcccctgaaggaaggtgcagtgatccggcagtggttgcagtgcaccctgctgtgtccctgaatgtggatgctgtgaacatgcagtggatgcagtgatcctgcagtgattgcagggggcctgaatttccatatcagctggaagcagtgtccctgaggtgttcccttgccacctactgtgtccctgaaggtgaatgcagtgcccatgcagtggatgcattgctcctgaaggtttatgcagtattttgtgacggaggatgcagtgcccatgatggtggatgcagtgtccctgcagtggttgcagtgcccccggcattgtgctggaagatggatgcaggtgtcatgcaatggattcagtgtcccacaatctggaggcattgtggtgtgttgtagtatgcagtgctgaagaagatgaatgcagtgatcctgcagtgatggcagtgcacctgcagaaccacttcagctggatgcagtgttgttgcagtggttgcagtgccacctgcattgtccttgaatgtggatgcactgcccagtcagtggatgcaatgtcccacaatgtggatgcagcatgtaatgacggatgatgcagttcccatgaatgtggacgcactgtccctgcagtgcttgcagtgcctcctgcattgtccaggaatgtggatgcagtagtcaagcagtggatgcagtgtcccaccaggtggatgcagtatgttgtgatggaagatgcagggccaatgaaggtggatgcagtgatgcttcagtggttgcagtgacccctacagttcactgaatccggatgcagtgcccatgcagtaggtgcagtgtcccacaaggtgtatgcagtatgttgtgatggaagatgcagtgcccacataggtggatgaagtgagcctgtgctgaatgcagtgcacttgcagtgtgacttcagctgtatgcagtgtccctgctgtggttgcagtgcccactgcattgttcaagaacgtggatgctgtgcccaggcattggatgcagtgtcccacatttgcatgcagtaggttgtgatggaggatgcagtgcccatgagggtgcatgcagtgatctggtagtggttgcagtgcaccctgctgtgtccctgaatgggcatgctctgacgatgcagtgggtgcagtgatactgcagtgattgcagtgagcatgcatttcctcatcagctggaagcagtgttgctctagaggttgcaatgccaccttcttgtccttgaaggtgaatgcagtacccatgcagtggaggcagtgtccctaatggtttatgcaatatgttgtgacggagattgcagtgcacatgaaggtggagtcagtgtccttgcagttgttgcagggcccctggcattgtgctggaatgttgatgcaggattcatgcagtggatgcagtgtctcccaaggcggatacagtatgttttgttggaggaggaactgcccatgaagctggatgcggtgaacctgcagtggttgcagtgccgactacaagttccctgaatgtggatgcagtgccgatgcagtgcatgcagtgtcccaaaaggtggatgcggtatgctgtgacggaggatgcagtgcccacgaagttggatgcagtgagcctgaagtgattgcagagccaactgcagtgtccctgagcatggatgcagtgtccacgcagtggaggcagtgtcccacaatgtgcatgcagtatgttgtgacagagggttcagtgatcatgaaggtggatgcagtgatcctgcagtggttgcagtgctactgcagtgccttttccctgaatgtggatatgcagtggatgcagtgatcctgcagtgattgcagggcgcctgcagtaccacatcagctggaagctgtgtccctgcagcgttgcagtgccactttctgtgtcactgaaggtgaatggagtggctatgcagtggatgcagtgtacctaaaggtttatgcagtttttttgtgatggaggaggcagtgcccatgaagggggatgcagtgtccctcctgtggttgcagtgcccaggcattgtcctgaaatgttgatgcagtgcctatgctgtggacgcactgaattttcagtgattgcattgcacctgcagtgccacttcacttggatgcagtgtagctgcagtggttgcatagccaactgccatgtccctgaatgtgaatgctgtgcccatgcagtgtctgcaatgtgactcaaggtgggtgcagtatgttgtgaagcaggattcagtgcccatgaaggaggatgcagttatcctgcagtcattgcagtgcacctgcagtgacacttcatctggctgcagtgtcactgcagtggcagcagtgcaccatgccatgtccctgaatgtgaacgctgtgaaaatgcagtggatgccgtcatcctgcagtgattgcagtgcccttgcatttcctcatcagctggaagcagtgttgctgcagtggttgcagtgccaccttttgtgcccctgaatttgaatgcacagcccatgcagtggaggcagtgtccctaaagggttatgcagtatgttgaaacggaggatgaagtgcgcatgaaggcagatgcagtgtccctgccgtcgttgagggcccccagcattgtgctggaatgtggatccaggggtcatgcagttgatgcagtgtctcacaaggcacaagttttgttggaggatgcagtgcccatgaaggaggatgcggagaatctgcagtggttgcagtgcctgctacagtttccctgaatgtggatgcagtgcccattcagggcatgcagtgtcccaaaaggtggatgcggcatgcagtgatggaggatgcagtgcccacaatggtggatgcagtgagcctgaactgcttgcagtgcgcttgcagtgccacttcagctggaaatagtgttgctgcagtggttgcagagccaactgcagtgtccgtgaacatggatgcagtccccatccagtggatgcagtgtccctcaatgtgcatgcagtatgttgtgacagaggatgcagtgcccatgaaggtggaagcagtgatccttcagtggttgcagtgccccctgcagtttaccttaatgtggatgcagtgctcatgcagtggatgcagtgtcactcaaggtggatgcagtatgatgttttggaggattcagtgatgatgaaggaggatgcagtgaacctgcagtcattgcagtgaacttgcagtgccacttcagctggctgcagtgtccctgcagtagttgcagagccaactgcagtctccctgaacctggatgcagtccccatgcaatggatgtagtgtccctaattgtgcatgcagtatgttgtgacggaggatgcagtgcccatgaaggtggaagcagtaatactgcagtggttgctctgccccctgctgagcaactggagtgtccctgcagtagttacagtgccccattctgtgtccctgagtgtggatgcagtgcccatgtagtggatgctatgtacaaaaagttggctgctgtatgttgtgacagaggatgcagagccttggagttggatgcagtgagctggcagtgattgcagtacgcattcagtgcgacttcagctggatgcagtatccctatagtggttgcaatgccacctgccttgtcctgggatgtggatggactgctcatgcagtggatgcagtgtctcacaatgtggagccattgtggtgcattgtagtatgcagtgcagatgaaggtgaatgcagtgatcctgaattgatggcagtgcgccagcagcgtcacttcagttggatgtagtattgctgcagtggttgcagtgtcccctgcagtttcactgaatgtggatgcagtgctcatgcagtggatgcagtgtccctcaaggtagatgccttatgttgtgatggtggaatcagtgatcatggaagaggatccagtgatcctgcagtcattgcagtcaacttggctggagtgtccctgcagtggcttcagtgccccgttctgtgtccccgaatgcagatgcagagcccatgcagtggatggagagaaccaaaagttggttgccatatgttgtgacagagaatgcagtgcccacgatttggatgcagtgagcctgtgtggaatgcagtgtgcctgcagtgcgacttgagctggatggagtgtccctgcagtggttgcagtgcgtactgcattgtccgtgtcgtggctgcagtgcccaggctttggatgcagtgtaacactatgtgcatgcagtatgttgtaacagaggatgcagagcccatgaaggtggatgcagtgatcctgcagtggttgcagtgcaacctgctgtgtccctgaatgtgcatgctgtgaacatgcagtggatgcagtgatcctgctgtgactggagtgcacctgcatttccacatgaggtggaagcagtgttcctgaaggggttgcagtgccatcttctgtgtacgtgaaggtgaatgcagtgcccatgcggtggaggcagtgtccctaaaggtttatgcagtatgttgtgacggaggatgcagtgcccatgaaggtggatgcagtgtcccagcagtggttgcagtgccccagcattgtccgggaatgtggatgcagtgcccagggagtagttgcagtgtcccacatggtggctgtcgtatgttgtgatggaagatgcagtgcccacgaaggtggattcagtgagcatgtgctgaatgcagtgtgcctgcagtgccacttcagatggactcagtgtccctgcagcggttgcagtgctgactgccttgtccgagaatgtagatgcagtgcccaggcattggatgcagtgtcccacaaggtgcatgcagtatgttgtgatggaggatgcaatgcccatgtaggtagatgcagtgatctggcagtggttgaagtgcaccttgctgtgtcccttaatttgaatggtgtgaagatgaagtggaagcagtgatcctgcagtgattccagtgtgcctgcatttccacatcagcctgaagcagtgtccctgcaggggttgcagtgccaccttctgtgtccctgaaggtgaatgcactgcccatgcagtggatgcagtgtccctgcagtgtttgcagtggccctcacattgtcctggaatgtggatgctgttgtcatgcagtggatgcagtgtctcacaaggcagaagcagtatgttttgtcttaggatgcactgcccaaaaagttggatgcggtgaacctgcagtggttgcagtgtctcctacagtctacctgaatgtggatgcagtgcccatgcagtgcatgtggtgtcctacacggtggatgcagtatgctgtgacagagcactcagtgcccacgaaggtggatgcagtgagcctgaagtgatagcagtgtgcttgcagtgccacttccgctggatacagtgttgctgcagtggttgcagagctaactgcagtgtcccagaacgtggatgcagtgcctattcagtgcatgcagtgtcccacaatgtccatgcagtatgttgtgatggaggatgcagtgcccatgaaggtggatgcactgatcctgcaggggttgcagtgccccctgctgtttacctgaatgtggattcagtgttcatgcagtggatgcagggtcccacaaggtggatgcagtatgatgtgatggaggatgcagggcccatgaaggtggatgcagtgatgctgcagtggttgcagtgccccctacagttccctgaatgtggatgtagtgcccatgcagtagttgctgtgccccaaaaggtggatgtcgtgtgttgtgatggaagatgaagtgcccaaggaggtgtatgcagtgagcctgtgctgaaagcagtgcacctgcagtggaacttcagctgaatgtagtgtccctgcagtggttttagtgtccactacattgtccgagaacgtggttgcagtggccaggcattggaagcattgtcccacaaggtgcatgcagtatgctctgactgagaatgcagtacccatgagggtggatgcagtgatccgacagtggttgctgtgtaccctgctgtgtccctgaatgtgcatgctctgaacatgcagtggctgcagtgttcctgcagtgattgcagtgcacctgcatttccacatcagctggaagcagtgtccctgcaggggttgcagtgccgccttctatgtccctgaaggtgaatgcagtgccaatgcagtggaggtagtgtccttaaaggtttatgtagtatgttgtgaaggaggatgcagtgcacatgaaggtggaggcagtgtccctgcagtggttgcagggcccccggcatagtgctggaatgtggatgcagcagacatgcagtggatgcagtgtctcacaaggcagatgaagtatgttttgtcggtagatgcagtgcccatgaaggtggatgcggtgaatctgcagtagttgcagagcccctacagtttccctgaaggtggatgcagtgcccatgcagtgcatgcagtgtcccacaagttggttgcggtatcttgtggcggaggatgcagtgcccacgaaggtgaatgaagtgagcctgaaggtattgcattgcacttgcagtgccaattgagctggatgaaaagttgctgcagtggttgcagtgcctcctgcattttctgggaatgtggatgcacttcccaggctgtggatgcagtgtcccacaatttggatgcagtatgttgtgacagaggatgcagtgcctacgagttttatgccgatggccagtgcggaatgcaatgagcctccagtgaaacttcagctgtatgcagtgtccctgcagtggttgcaatgccctctgcattgtcctcaaatgtggatgcagtgctcatgcagcggacgcagtgtgccacaatgttggaggcattgtggtttcttgtagtatgcagtgcctatgaaggtgaatgcagtgatcctgcagtgatggcagtgcacctgcagtgccacttcagctggatgcagtgttgctgcagtgttagcagcgccccatcctttgtctgggaatgtggatgcagtgcacaggaagtggatgcagtgtcccacatgggggatgcagaatgttatgatggatgatgcagttctgatgaaggtgatgcagtggccctggagtgcttgcagtgaccccagcattgtccagaaatgtggatgcagtagtcatgcattggatgcagcgtcccacaaggtggatgcaatatgttctgatggaggatgcagtgcgcatgaaggcagatgcagcgtccctgcagtggttgcagggaccccggcattgtgctggaatgtgaatccatgggtcatgcattggatgcagtgtcacacaaggaggatgcagtatctattgtctgaggatgcagtgcccatgaatgtggatgcagtgaccctgcagtggttgcagtgccccctacattttccctgaatgtggatgcagtgctcaggcagagcatgcattttcacccaaagtggatgcattattttgtgacagaggatgctgtgcccatgaaggaggatccagtgtccctgcagtggttgcagtgcccccggcattgtcatgaaatgttgatgtagtgccaatgcaggtaatgcagtgaaacttcagtgattgcagtgtgcctgccttgacacttcagctggatgcactgtagctgcagtggttgcagagccaccatttctgtccgtgaaggtgaatgcagtgcccatgcagtagatgcagtgtacctaaaggttattgcagtatgttgtgatggaggaagcactgtgcataaaggtggatgcagcgagcctgcattggttgcagagcccctggcattgtgctggaatgtggatgcagtcgtcatgaagtggatacagtgtctcaaaaggcggatgcagtatgctttctcggagtatgcagttccaataaaggtggatgcggtgaacctgcaatcatggcagtgcccaccacagtttccctgaatatggatgcagtgcccatgcagtggatgcagtgtcccacaatgtgcatgcagtatgttgtgatggagcatgcagtgcccatgaaggtggatgcagtgatcctgcagtggttgcagtgccccctgcagtttacctgaatgtggattcaggggtcatgcagtggatgcagtgacccccaaggtggatgcctcatgttgtgttggaggatccagggatcatgaaggaggatgcagttatcctgcagtcattacagtgcaactgcagtgccccttcagctggctgcagtgcccctgcagtggttgcagcgcctggttctgtgtctgtgaatgtggatgcagtgcccatgcagtaaatgcagagtatcaaaatttggttgccgaatcctgtgacagatgatgcagtgcccacaagttatatgcagtgagctggcagtgattgctgtacgccttcagtgccacttgacttgactgcagtgtccctgcagtggttgcaatgcccccagcattgtcctggaatgtggatgcagtgctcatgcagtggatgcagtgtcccacaaggtggatgcagtatgttgtgatggaggatgcaagcccatgaaggtgggtgcactgatcctgctggggttgcagtgccccctacagttccctgaatgtggatgcagtgcccatgtagtagttgccgtgtcccacaaggtggatgtcgtatgttgtgatggaagatgcagtggccatggaggtggatgcagtaagcctgtgctcaatgcagtgtgcctgcagtgtgacttcagctgtatgcagtgtcattgcagttgctgcagtgcccactgcattgtctgagaacgtggatgcattgcccaggtttggatgcagtgacccacaaggtgcatgcagtatgttgtgatggaggtatcagtgcccatgagggtggatgcagtgatccggcattggctgcagtgcaccctgctgtgtccctgaatgtgcatgctctgaacatgcagtggatgcagtgatcctgcagtgatttagtgcacctgcagtgtcactacagctggatgcagtgtatctgcagaggttgcagagccccctgccctgtccatgaatgtggaggttgtgcccatgcagtgtctgcagtgtgactcaaggtggatgcaatacgttgtgaagtagtattcagtgtccgtgaaggatgatgcagtgatactgcagtaattgcagtgcacctgtagtgccacttcagctgggtgcagtatccctgctgtagttgcagtgcacccggctgtgtccctgaaggtgcatgctctgaacatgcagtggatgcagtgatcctgcagtgattgcagtgcgcttgcctttccacataagctggaatcagtgttgctgcagtggttgcagtgccaccttctctgtccatgaaggtgaatgcagtgcccatgcagtggatgcagtgtacctaaagctttatgcagtatgttgtgacggaggatgtagtgcccaaggagggggattcagtgttcctctagtgtttgcagtgctcccggcattgtcctgaaatgttgatgcaccacctatacagtggatgcagtgaatcttcagtgattgcagtgcacctgcagtgccacttcagctggatgcagtgtagctgcagtggttgcagagccccctgccatgtccctgaatgtggatgatgtgctcatgcaatgtctgcagtgtgactcaaggtggatgcaatatgttgtgaagtaggagtcagtgtccatgaaggatgatgcagtgatcctgcagtcattgcagtgctcctgcagtgccacttcatctggatgcagtgtccctacagtggttgcagtgcagcctgctgtgtccctgaatgtggatgctgtgaacatgcagtggatgcactgatcctgcagtgattgcaatgcacctgcattacctcattatctggaagcagtgttgctgcagtggttgcagtgccaccttctgtgtccctgaaggtgaatgcagtgcccatgctgtggaggcagtgtccctaaaggtttttgcagtatgttgtgacggaggatgcattgcgcatgaaggcggacgcagtgtcactgcagtgttttcagggcccccagcattgtgctggaatgtggattaagtggtcatgcattggctgcagtgtcacacaaggaggatgcagtatgttttgtcagaggatgcagtgcccatgaaggtggaagcggtgaacctgcattatttgcagtgcccattacagtttccctgaatgtggatgcagttcccatgcagagcatgtagtgccacccaaggtatatgcattatgttgtgacggaggatgcagtgcccatgaaggaggatccagggtccctgcagtggttgcaatgcccccggcattgtaatgaaatattgatgcagtgcgaatgcagggaatgcagtgaaacttcagtgattgcagtgtgcctgcagtgacacttcagctgaatgcactgtatcttcagtggttgcagagccaccttctgtgtccgtgaagatgaatgcagtgcccatgcagtggatgcagtgtacctaaatgtttatgctgtatgttgtgatggaggaagcagtgtgcatgaaggtggatgcagtaaaccagcagtggttgcagtgacccctgcagtttcatttaatgtgtatgcagtgtccatgcagtgcatgcagtgtcccacaagatggatgtggtatgctgtgacggaggatgcagtgcccacgaaggtggatgcagtgagaatgtgctgaatgcagtgcgaatttggctctatgcagtgtccctgcagtgattgccatgcccactgcataacctgagaacgtggatgcagtgcccaggccatgtatgcagtgtcccacaaggggcatgcagtatgttctgatggaggatgcaatgcccatgagggtggttggagtgctccggcagtggttgcagtgcaccctgctgtgtccctgcagttggatgctgtgaacatgcagtggatggagtgatcctgcactgattgcagtgcgcccacatttccacatcagctagaagcagtgtccctgcaggggttgcagtgctgaattctgtgtcactgaaggtgaatgcagtgcccatgccgtggatgcagtttacctaaaggtttatgcagtatgttgtggcggaggatgcagtgcctatgaagggggatgcagtttccctgcaatagtgcactgcacccagcattgttctggaatgtggatgcagtgttcatgccgtggatgcagtgacttacaaggcagatgcagtatgttttgtcgggggatgcagtgcccatgaaggtggatgcggtgaacctgcagtggctgcagtgccccctacagtttccctgaatgtggatgaagtgcccatgcagtacatgcagtgtcccaccaggtggatgaagtatgatgtgaaggaggatgcagtgcccatgaaagtggatgcagtaagccttcagtgattgcagggctccttcagtgccacttaagatggatgcagtgttcctgcaatggttgaagagccaactgcagtgtcccagaacgtggatgcagtgccgatgcagtggatgcagtgtcccacaatgtgcaagcattatgtcatgacggaggttgcagtgcccatgaatggggatgcaatgatcttgaagtggttgcagtgccacctgcagtttacatgaatgtggatgcagtggtcacgcagtggatgcagtgtccctcaagtttgatgcctcattttgtgatggaggattcagtcatcatgaaggaggatgcagtgattctgcagtcatagcactgcacctgcatggccacttcagctggctgcagtgtccctgctgtgcttgcagtgccccccacattgtccaggaatgtggaggcagtagtcatgcagtggatgcagtgtcccacaaggtggatgcagtatgttttgatggaggatgcagggcccatgaaggtggatgcagtgatgctgcactgcttgcagtgccccctcagttccctgaatgtggatgaaatgcccatgcagtagttgcagtgtccctcaaggtgtatgtcttatgttgtgatggaagatgcagtgaccacagaggtggatacagtgggcctgtgctgaatgcagtgcttttgcagtgtgacttcagctgtatgcagtgtccctgcagtggtttcagttcccactgcattgtccaagaacgtggattcagtgcccaggcattggaagcagtgtcccacaagttggatgcagtatattgtgacggatgatgcagttttcatgacggtggattcagtgtctctgcagaggttgcagtgaccctgccatggtgatggaatgtagctgcagtggtcatagagtggattcagtgtctcacaaggcagatgcagtatgttttgtttgaggatgcagtgcccatgaaggtggatgtggtgaacctgcagtgtttgcagtgctccctacagtttccctgaatatggatgcagtgctcatgcagcggatgcagtgtccctcaatgtggaggccttatgatgtgttggaggattcactgatcatgaagtagtatgccgtgattctgcagtaattgaagtgcacctgcagtgccacttcagctagctgcagtgtccctgcagtggttgcaatgcccccagcattgtcctgaaatgtggatgctgtgctcatgcagtggatgcagtgtcccacaatgtggaggcattgttgtgggttgtactatgcagtgccgatgaaagtgaatgtagtgatcctgcagtgaggacagtgcacctgcatagccagttcagctggattcagtgttgctccactggttgcagagcccactgcagtgtccctgaacatggatgcagtgaccatgcagtgaatgcagtgtccctgaaggaggatgccttatgttgtgatggaggatgaagttcccacgaaggtggatgcagtgatcctgcagtattttctctgaccctgcagttttcctgaatgtgtatgcagtggtcatgcagtggatgcagtgcccctcaaggatgccttatgttgtgatgtaggattcagtgatcatgaaggaggatgcagtgatcctgcagtcatggcagcgcatctgcagggccacttcagctggctgcagtgtccctgcagtggttgcagtgccctgttctgtgtccctgactgtgtatgcagtgcccatgcagtggatgcagagtacccaaatctggttgccgtatgttgtgacggaggatgcagggcccacgagttggatgcagtgagccctcagtgattgcaggatgccttcagtgccacttcttctggatgctgtgtctctgcagtggtggcagggcgcactgcattgtccaagaacgtcgatgcagtgcccaggcattggatgcagtgtccgacaaggtgcatgcagtatgttgtgatggacgatgcagtgcccatgggggtggatgcagtgagtctctgctgaatgcagtgagcctgcagtgcgacttaagctgtgtacagtgtccctgcagtggttgcagtgccaactgcattgtccgagaacgtggatgcagtgcccaggcagtgggtgcattttcccacaaggtgcatgtagtatgttgtgacggaggatgcagtgcccattagggtggatgcagtgattgtgcagggattgcagtgcacctgcatttctgcatcagctggaagcagtgtccctgctggggttgcagtgtctccttctatgtcactgaaggtgaatacagtgcctatgcagtggattcagtgttcccaaaggtttatgcagtttgttgtgatggaggaggcagttcccatgaagggggatgcagtgtccctcctgtggttgcagtgcccaggcattgtcctgaaatgttgatgcagtgcctatgctgtggatgcactgaatcttcagtgattgcattgcacctgcagtgccagttcagttggatgcagtgtagctgcagtggttgcagagccaactgccatgtccctgaatgtggatgctgtgctcacgcagtgtctgcaatgtgactcatggtggatgcagtatgttgtgaagcaggattcactgcccatgaaggaggatgcagtgatcctgcagtcattgcagtgcacctgcagtgccacttcatctggctgcagtgtcactgcagtggtggcagtgctccctgctgtgtccctgaatgtggatgctgtgaacgtgcagtggatgcagtgatcctgcagtgattgcagtgcgcctgcatttcctcatcagctgcaagctgtgtggctgcagtggttgcagtgccaacttttgtgtccctgaatttgaatgcagtgcccatgcagtggatgcagtgtccctcaatgtgaatgcagtatgttgtgccggaggatgcagtgcccatgaagttggaagcagtgatactgcagtgatggcagtgcacctgcagtgacacttaagccagacacagtattgctgcagtggttgcagtgccccctacagttccctgaatgttgatgtggttcccatgcagtagttgccgtgtcccacaagttggatgtcgtatgttgtaatggaatctgcagttcccacggaggtggatgcagtgagcctgtgctgaatgcagtgcatctgcagtggtttcagtgcccactgcattgtccgagaaaatggatgcagtgaccaggcattgtatgcattgtccctcaaggttccatgcagtatgttgtatggaggatgcagtgcccatgggggtggatgaagtgatcctgcagtgactgcagtgcgcatgcatttccagatcagctggaagtagtgtcactgaaggggttgcagtgctgcattctgtgtcgtgaaggtgaatgcagtgcgcatgcagtggatgcagtgtactccaaggtttatggagcatgttgtgatggaggatgcagtgcccatgaagggggatacagtgtgcctgcagtggttgcagtgcccctggcattgtcctgaaatgttgatgcagtgcctatgcggtggatgcagtgaatcttcagtgattgcagtgcgcctgcatttcctcctcaactggaagcagtgttgctgctgtggttgcaatgccaccttccgtgtcactggaggtgaatgcagtgccaatgcaatggagacagtgtacctaaaggtttatgtagtatgttgtgacggaggatgcaatgcccatgaagggtgatgaaatgtccctccagtcctggcagtgcccctggcattgtcctgaacatgtgatgcagtgcctatgcagtggattcagtgaatattcagtgattgcagtgcacatacagtgcctcttcagctggatgcagtgttgctgcagtggttgcagtgcaccctacattgcatgggaatgtggatgcagtgtcccacaaggttgatgcagtatgttatgtcggatgatgcagttctcatgaacgtggaggcagtgtcccagcagtgcttgcattgcccgccgcattgtctgggaatgtggatgcagtagtcatgcagtggatgcagtgtcccacaaggtgtatgcagtatgttgtgatggaggat

SEQ ID NO: 81 - DNA, 1342 bp, Equus caballus
atgcagtggatgcagtgtcccacaaggtggaggcattatgttgcgatggagtatgcaggcccatgaatgtggatgcagtgatgctgcagtggttgcagtgccccctacagttccctgaatgtgggatgcagtgccatgcagtacttgaagtttcacataagttggatgtcgtatgttgtcatggaagatgcagtgtcctcgaatttggatgcagtgagcctgtcctgaatgcagtggcctgcagtgtgacttcagctgtatgcagtgtccctgcagtggttgcagtatcgactgcatgtccgagaatgtggatgcagtgcccaggcattggatgcagtgtcgaaaaaggtgcgtgaagtatgttgtgacggaggatgcagtgcccatgagggtggatgcagtgatccggtggtagttgtagagcaccctgctgtgtccctgaatgtgcatgctctgaacatgcagtggatgcagtgatcctgcagtgattgcagtgcgcctgcctttccacatcagctggaagcattgtccctgcaggggctgcagtgctgccctctgtgtcgctcaaggtgaatgcagtgcccatgcagtggatgcagtgtacctaaaggtctatgcagtatgcagtgacgcaggatgcagtgctcatgaatggggatgcagtgtccctccattgattgcagtgcccccgacattgtcctgaaatgttgatgcagtgcctatgcagtggttgcagtgaatcttcagtgattgcagtgtgcctgcagtgcaacatcaactggattagtgtagctgcagtggttgcagagccccctgccatgtccctgaatgtggatgctgttcccatgcagtttctgcagtgtgactcaaggtggatgcagtatgttgtgaagtaggattcagtgcccatgaaggaccatgcagtgatcctgcagtcattgcagtgcaactgcagtgccccttcatctggatgcagtgtcctgtactggttgcagtgcacccggctttgtcactgaatgtggatactgtgaacatgcagtggatgcagtgatcatgcagtgattgcactgtgcctgcatttcctcatcagctggaagcagtgttgctgcagtggttgcagtgccgccttctgtgtcactgaagttgaatgcagttcccatgcagtggaggcagtgtacctaaaggtttctgcagtatgttgtgacggaggatgcaatgcccttgaagggtgatgaagtgtccctccagtggttgcagtgcccccagcattgtcctgaagttttgatgcagtgcactatgcagtggatgcagtgaatattcagtgattgcagtgtgcctacag

SEQ ID NO: 82 - DNA, 1342 bp, Equus caballus; identical to SEQ ID NO: 81

SEQ ID NO: 83 - DNA, 2985 bp, Equus caballus
catgaaggaggatgcagtgagcctgaagtgattgcagtatgcttgctgtgacacttagctggatgcagtgatcctgcagtggttgcagtccccctgcagtttacctgaatggggattcagtgctcatgcagtggatgcagtgtccttcaaggtgtatgccttatgatgtgttggaggattgagggatcgtgaaggaggatgcggtgatcctgcagtcattgcagtgaacttgcagtgccacttacgctggctgctgtgtcaaagcagtggttgcattgccccatcctgtgtccctgaatgtgtatgcagtgtccatgcagtggatgcagagtaccaaaagaagattgccgcatttgtgacggaggatgcacagccctggagttggatgcggtcagccagcattgatagtcagatgcctgcagtgccacttcagttggatgcagtgtcctggcagtggttgtcctggaatgtggatgccgtgctcatgcagtggatgcaatgtcccaaaatgtggaggcattgtggtgtgttgtagtatgcagtgcggatgaatgtgaatgcagtgatcctgcagtgatggtactgcgcctgcagtgccacctgggctggatgcagtgttgctgcagtggttgcagtgccctctgcagtttacctgaatgtggatgcagtgctcatgcagtggatgcagtgtccctcaaggtggatgccttatgatgtgttggaggattcagggatacgtaaggatgatgcagttatcctgcagtccttgcagtgaacttgcagtgccacttcagctttctgcagtgtccctgaagttcttgcagtgccgcgtcctgtgtccctgagtgtggatgcagtgcccatgcagtggatgcagagtaccaaaggttggctactgtatgttgtaacagaggatgcagagccctggagttgaatgcagtgagccagcagtgattgcagtgcacctgcagtgcaacttcagctgtatgcagtatccctgcagtggttgcagtgccgactgcattgtctgagaacgtggatgcagtgcccaggcattggatgcagtgtccctgctttggttgcagtgcacccggagttgtcctggaatgtggatgcagtggtcatgcagtggttgtggtgtctcacaaggcagatgcagtatgttttggcggatgatgcagtgccaacgagttggatgcagtgaggctgtgtggtatccagagcacctgcagtgcaacttcagctctatgcagtgtccctgcagtgggttcaatgacccctgctttgtcctggaatgtggatgcagtgcccatgctgtggatgcagagtaccaaaatttggttgtcatatgctgtgacagaggatgcagtgcccacgagttggatgcagtgatcctgtgcagaatgcagtgtgcctgcagtgcaacttcagctttatgcacagtccctgcagtggttgcaatgccccatgaattgtccaggaatatagatgcagtgctcatgcagtggatgcagagtcccaccatgtggaggcattgtggtgcgtggtagtatgcagtgccgatgaaggtgaatgcagtgatcctgctgtgatggcagtgcacctgcagtgccacttcagctggatgcagtgttgcacagtggttgcagcgccccctgaatgatccgtgaatgtggatgcagtgcccaagcagtggatgcagagtcccacaaggtggatgcagtatgttatgacggatgatgcacttctcatgaaggtggatgcagtgtccttgcagtgccccccacgttgtccgggaaagtggattcagtagtcatgcagtggatgcagtgtccatcaaggtggatgccttatgatgtgttggaatattcattaatcatgaaggaggatgcagtgattctgccatcatagcagtgcacgtgaagtgtccctgcattggttgcagtgtcccgttgtgtgtccctgaatgtggatgcagagcccatgcagtggattcagagtaccaaaagttggttgacgtatgttgtgacagaggatgcagagacctggagttggatgcagtgaaacggcagtgattgcagaacgccttcagtcccacttcagctggatgcagtgttcctgcagtggatgaaatgccccctgccttgtcctggaatgtggatgcagtgcttatgcagtggctacagtgtcccacagggtggatgcggtatgctgtgccagaggatacattgcccatgaaggtgggtgcagtgatgctgtagtggttgcagtgccccctacagttccctgaatgtagatgcagttcccatgcagtagttgcagtgccccacaaggtggatgtcatatattgtgatggaagatgcagtgcccacggagttgcatgcagtgagcctgaagtgattgaagtgcccttgcagtgccacttcagctagatgcagtgttgctgcagtggttgcagagccaacagcacgtggatgcagtgcctatgcagtggaggcagtgtcccacaatatccatgcattatgttgtgtcggaggatgcagtgaccctgaagatggatgcagtgatcctgccgtggtggcagtacccacctgcagtttacctgaatgtggatgcagtgctcatgcagtggatgcactgtcgctacaggtggatgacttatgatttgttggaggattcagtgatcatgaaggaaggacacagtaatcctgctgtcacagcaaatgaacttgcaggggtcaattcagctggctgcagcgtccctgcagtagttgcaggtgccccgcccctgtgtccctgagtgtggatgcagcgcccatgcaggttgatgcagagaccaacaaatggttcccgctttgttgtggcaggagaaagaggagctactggtagttggatgcagtgaagccggcagggattgccagttcgccttcaagtgccacctcaaactgaagccaggtgacccctgccaggagatgggaggggccc

SEQ ID NO: 84 - DNA, 2985 bp, Equus caballus; identical to SEQ ID NO: 83

SEQ ID NO: 85 - DNA, 1558 bp, Equus caballus
gtcccgcagtcggttgcaggtgcccactgcattgtttcggagaataggtgatctcactggaaagtcaatgggtatgcaagtttcccaccaagtgggattgcaagtatgttttgacggatagagccagtttcataaagttggatgccatggtccctgcagtgcatgcagtgcccccttcattaccgggaaatatgggatgccgttgtcatacagtgggagttgtgtcccgcaaggtacatgcagtatgatgtgacgtaggatgcagtgtccatgaaggttgaatgcagtgatctgccagtttttgcagtgctcccatgctgtgtccctgaatgtggatgctgtgaaacatgtagtggatgcagtgaccctgcagtgattgcagtgcgactgcatttccacatcaggtggatgcagtttccctacaggggttgcagtgccgtcttctgtgtctctgaagttgaatgcagtgcctatgcagtgggtgcagtgtacataaaggttaatgcagtatgttgtgtcggaggatgcagtgcccatgaagttggatgcagtgtccatgcagtggttgcaatgcccctgacattgtcctggaatgtggttgcagtggtcatgcagtggatgcagtgtctcacaaggcagattctgtatgttttgcttgaggatgcagtgccaacgagttggatgctgtgagcctgtgcagaatacagtgcaccagcagtatgacttcaactgtatgcagtgtccctgctgtggttgcaatgcccccttcattgtactggaatgtggatgcagtgctcatggagtggatgcagtgtcactcaaggtggatgcagtatgttgtgatggaggatgcagtgcccaagaaggtagatgcagtgatcgtgcagtggttgcagtcccccctacagtttcccttaatgtggatgaagtgcccatgcagtggatgcagtctccctcaaggtggatgcggtatgttttgacagaggatgcagtgccaagaaagtggatgcagtgttcctgcagtcattgccgtgcacctggagtgccacttcagctggatgcagtgtccctacagtttgcagtgcccccttcattgtcctggagtgtggatgcagtgctcatgcagtggatgcagtgctcatacagtggatgcagtgtcccacaatgtggaggcattgtggtgtgttgtagtatgcaatgccgatgcaggtgaatgcagtgatcatgcagtgatggcagttcggctgcagtgcgacttcagctgtttgcagtgtccctgcagtggttgcagtgcccactgcattgtccgagaactgggtgccatgcccagtcattggatacagtgtcccacaaggtgcatgcagtatgttgtgatggaggatgcagggcacatgaaggtggatgcagtgatcctgctgtggttgcagtgcccctgcagtttacctgaatgtggatgaagtgctcgtgcagtggatgcagtgatcctgcagtgatttaagtgtgcctgcatttccccatcagctggaagaattgtccctgcaggggttgtagtgctgcc

SEQ ID NO: 86 - DNA, 3627 bp, Equus caballus
tggcatgcccagcacgtgattccggaataccatgaagtggttctggcatagccggcaggtgattttggttatgtccagcaagtggttccggcatgtcgagtaggtgtttccggcatgctgggcaggtgcatccgctgtctttggcatgtggttctggcatgtctgacaggtggttccggcatgcccggtaggtgattccagtgtgtccaccaagtggttctggcgtagccggcaggtgattttgcgtgtcaagcggtggttccggtgagtcgagcaggtgtttctgatgtgtccggcaggtgtttccagcctgtccaggaggtggttcctgagtgtccagctcgtgcttctggcacatctgagaggaggtcccggcatgccggccagtttatcccggagagtccgacaagtggttctagcatagccggcaggtgattttggtgtgtccggtagctgggtcgggtgagccgagcaggtggttctggcatgctcggctggtggttcaggcgggtccggcaggtggttccggtctgtccgggaggtggtgccggcgtgtccggcatgtgcttctggcacgtctgagaggtggttgcggcatgcccgacaggtgattccggagtgtccgccaagtggttctggggtagccggcaggtgattttggagtgtctggcaggtggttctgtggagttcatcaggtacttctggcattctcggcaggggcttccgcgtgtccggctcatgtttctggcacgtctcagatgtggttccggaatgcccggcagcaagtggttctcgtgtagctggcaggtgattttggagtgtctggcaggtgtgtcctgggagccgagaaggtggttccggcctgctcagcaggtgcttccagcgactccagcacgtgtttctggcacatctgagaggtggttccggcatgcccggcaggttattccggagtgtccggcaactggttctggtgcagccggcatgtgattttggcatgtccggtaagtgggtcctgcgagtcgagcaggtggttcctgagtgctccgcaggtggttcaggagtgtccagcaggtggttgcagtctgtccaggacgtagttctggcgtgtccggcacctggttctggtacgtctcagaggtggttccggcatgcccggcaggtgattccggactgtccaccacgtggttctagcatgtctgagaggtggttctgtcatgcccggcaggtgatcccggagattccgagagtggttctggcttagccggcatgtggttttgacgtgtctggtaggtggttccagcgagtggagcaggtggttccggcgtgctcggctggtggttcaggcgggtccggtgggtggttacggtctgtccgggaggtgcttccggtatgtccggcatgtggttctggcacgtctgagaggtggttccggcatgcacggcagctgatcccggagagtcctccaagtggttctggcatagccccgaggtgattttggcgtgtcagacaggtggttctggcatcctcggctgttggttcaggtggtgtccggcaggtggtgccggtctgtccaggaggtggttccggcatgtatgagaggtggttccggcatgtatgagaggtggttctggcatgctcagcaggtgattccaaagagtctgccaagtggttctggcatatgcggcaggtgattttgtgtgtccggcagtggttccggcgagtcgagcaggtggttccggcgtgtctggcagttgtttccagtctgtccaggacgtggttctggcgtgtccggcacgtggttctgttacgtctgagcggtggttcccgcatgcccggctggtgattccggactgtccgccacgtggttctggcatgtctgagaggtggttctggcatgcccgacatgtgattccgaaatgtctgccaagtggttctggcagagccggcaggtgattttggtgtgtcctgcaggtgggtcttgggagtcgagcagagggttcccgtgtgcttggcaggttgttcagaggtgtccggcaggtggttccagtctgtccaggacgtgtttccggcgtgtccggcacgtggttctggtacatctcagagctggttccggcatgcctggcaggtgattccagagagtgcaccaagtgcttctggtgtagccggcagttgattgtggcgtctccaacaggtggttaaggcgagttgagcaggtgtttccgacatgcttggcaggtgcttccagtgtctttggcatgtggttctggcatgaccggcaggtgattctggagtgtccgccaagtggttctggcatagccggaaggtgatttttcgtgtccagcagtggttccagggagttgagcaggtggttccggcgtgtctggccggtgcttccagtctgtcctggaagtggttgcagcgtgtccgacacgtgcttctggcacgtctgagaggttgtgccggcatgcgcggaacaattttccggcttgtccaccaggtggttctggcatagctggcaggtgatttgggcatgtccggcaggtgggtccagcaattcaagcaggtggttccggtgagtctggcaggtggttccagtctgtccgggaggtggatccggtgtgtctggcatgtgcttctggcacgtctgagaggttgtgctgggatgcccggcaggtgtttccagagtgtctgccaagtggttctggtgtagccggcaggtgattttgtgtgtccggcggtggttccggagagtcaatcaggtggctccactgttctcggcaggtggttccggcgtgtacggcacgtggttctggtacgtctcagaggtggttgcgcatgcccaacaggtgattccggactgtccgccacgtggttctggcacgtctgagaggtgattccagcatgcccggcaggtcatccgggagagtcccccaagtggttcagtcacagcccgcaggtgattttggcgtgtctggcaggtggttccgtcgtgctcggcaggtggttcaggcgtggccggcaggtggttccagtctgtccaggatgtgtttccagcatgtccggcacgtggttctggtacgtctgagatgtggttccgccatggctggcaggtgattccggactgtccccaggtggttctggcatagccagcagttgatattggcctgtccggcaggtgggtccggcgagtcgagcaggtggctgtggcgtgttcggcaggtggttctggcatgtctggcaggtggttccgttctgtccgataggtcgttctggcatatccggcacatgcttctggcacgtctgaaaggtggttctggcatgccaggcaggtgattccggagtgtcaggtaagtggttctggtgtagctggcagttcattttggcatgtccagcacgtgggtcctgtgcgttgagcaggtggttccggcgtgctcggcaggtgttccaggcgtgtctggcaggtggttccagtctgtctaggacgtggttccagcgtgtctggcacgtggttctctaacatctgagaggtggttcctgcatgcccggcaggtgatttggagtgtccgccaggggatctcgcatagcccgctgttgattttgcactggcccggaggtggtcccagccaa

SEQ ID NO: 87 - DNA, 8549 bp, Equus caballus
ccaccaagtggttttggcatagccggcaggtgatttgggcgtgtccgacagttgcttcaggcgagttgagctggtgtttctgacgtgctcgggcaggtgcttccggcgtctccggcacgggttctggcacatctgacaggtagttccggcatgcccgaaaggtgattccggtctgtccggtaggtggatccggcgtgtacggcacgtggttctggtccgtctcagaggtggttgcacacgcccaacaggtgattccagactctctgtgacgtggttctggcacgtctgtgaggtgcttcgggcgtgcccagcaggtgattcctgggtgtccgccaagtggttctggcgtcaccggcaggttattttggtgtgtccggcaggtctttcctgctttttgggctcgtggctctggcttgtaagacagatgcttgtggcatttctggcccccgttcttacatactcctcagctggtctcagggtttctgtcacctgtttgtggcatatccaacaggtgtttacaatatgtctggcatgtcattgtgctatgtttggaatctggttccgtcatgtcattgtgtgcggctggcatgttgaagagatggttctgcagtgtcagaatcgctgctccactgtgtccggcaggtggttacaggtggttctggcatgcaacgtgtgtgcttctggtatgcctgttgggtcatactggcatgaatgtgtggccctttgagagtgtgcggagggtgtttttggcatgtctcccggggttttctggcacataaggggcatgattcctttttatacgtcaggtgagtttgttctcagcttcctcaagagatggaaggaagatggtgtgtggcttgtggccccttgaggggtggagccaatgcattgtgcattccaatctagagcaatggagggcatggctgagagcaaaagggtctttcggacatagctgcattctgacactctctccaccagtgcacaatggtggttggaaaaaggcttacattctagcgcctcctgagcaggtggatgctaaatcatttgggactcagcccagttgcttcaggggaagatgtaggcatttcgtctgagcaaggttggcaaggtagaactgcggcagaagcagaagtcctaaagcagcgagttaagatctgggaagaaatggcgtttgagctgactttgtatgagagtttcctcgtatgctgtaacagcactatggaaagcgagttctttctcagcttcctaaagagctggagacaagacaatttatggcttgtctcccattgaaggaaagaggcagtgctttgtgccttccacctgcagagcaatggagggcatggctgagagccaagggggctttctgccattggtgctttctgatacccttcaggggtgatgccagtgccttgtgcctcctacctctagaggaatggagggcaagaccaagagtaaaaggactttctgaaattggtggtttctgacactgccccaaccattgctcaagggcggttggttaaaagcctattgtctgtctcctcctcagcatgtggaaccacaatcatccaggccttgtccccattgctcaaggggcagatgtaggcatttcgtctgagccgggtgggcaaggtggaaatgcggcagaagcggatgttgcacattggcgagttaagggctgaaaagacacggcgttcaggtgcctttgtatgagatgttcccaggatgctgcaagagcactgtggaatgcgagtgctctcccagcttcctaaagagctggaagcaggacagtttatggcttgtctccaattgaaggatggaggcagtgctttgtgccttccacctctagagcaatggagggcacggctgagagcaaagggcccgttctgacataggtgcattcagacactctctgcaccagtgcacaatggctgtgtttaaaaagcctattgtctgctcctgctaagcatgtggaagcacaatcatctgggcctcgtgcccattgctgaaggggaagatgtaggcatttcgtctgagccgggttgccaaggtggaaaggtgcaggatgaagatgtcccagactggccagtgaagtgctgaaggaaacggcgttcagcctcctttgtatgagatgttcccaggacgctgtaagggcactgtggaaagggagttttttctcagcttcctaaagtgctggaagcaggacaagatgtggtttgtctcccattgaggggtggatccagagccagtgccttgcgccttccacctctagagcaatgaagggcacggctgtgagcaaaggggcctttctgacatagcttctttatgaaaatctctccagcagtgcacattggtggttggaaaaaggcgtgcagtctatcgcctcctaagcacgtggatgctcaatcatttgggactcagcccagttgcttcaggggaagatgtaggcatttcgtctgagctgggttggcaaggtggaattgcggcagaagcagaggtcctaacgctgcgagttaagcactgggaagaaatggcgtttgagctgcctttgtatgagaggttcctggtatgctgtaacaggactgtggaaagcgagttgtttgtcagcttcctaaagagctggaggcaagacaatttatggcttgtctcccattgaaggatggaggcagtgctttgtgccttccacctgcagagcaatggagggcacggctgagagccaagggggctttctgccataggtgctttctgatccccttcaggggtggtgccactgccttgtgcctcctaccatgagaggaatggagggcacggccaagagtaaagggcctttctgacattggtgctttctgacactaccccaaccactgctcatgggcggttggttaaaagcctattgtctgtctcctcctcagcatgtggaaccacagtcatccgggcctcgtccccattgcttaaaagggaagatgtaggcatttcgtctgagccgggttggcaaggtggaaatgcggcagaagtggatgttgcagattggcaagttaagggctgaaaagacatggcattcagctgctttgtatgacatgttccctggatgctgtaagagcactgaggaatgcgagtgcttccccagctttctaaagagctggaagcaggacagtttatggcttgtctccaattgaaggatggagacagtgctttgtgccttccacatctagagcaatggagggcacggctgagagcaaagggccctttctgacataagcgcattctgacactctctgcaccagtgcacaatggcagtttgtaaaaagccttttgtctgctcttgctaaacatgtggaggcacaatcatctgggcctcatccgtgttgctgaaggggaagatgtaggcatttcatctgagcggggttggcaaggtggaaatctggcagaagcagaagttctaaatcggcgagttaagcgctgaaaagaaatggcatatcagcttcctttgtatgaggtgttgccaggacacagaaagagcactgttgaaagcgagttctttctcagcttcctaaagagatggaaggaagatggtctgtggcttgtcgccccttgagggggggagccagtgcattgtgcattccacgtctagagcaatggagggcagagctgagagcaaaggggtctttctgacatagctgctttccgacactctctccaccagtgcacaatggtggttggaaaaaggcgtgccgtctatcacctcctaagcacgtggacgctcaatcatttgggacacagcccagttgcttcaggggaagatgtaggcatttcgtctcgccgggttggcaaggtggaattgcggcaaaagcagaattcttaatgcggcgagttaagcactgggaagaaatggcgtttgagctgcctttgtatgagtgtttcctcgtatgctttaacagctctgtggaaagcgagttctttctcagcttcctaaagagctggaagcaagacagtttatggcttgtttcccattgaaggattgaggcagtcctttgtgccttcctgctctagagcaatggagggcactgctgagagtaaaggggtctttctgcagttggtgctttctgacactctctcaaccattgcacttggtggttagttaaaagcctattgtctctctcctcctcagcatgtggaaccacaatcatccgggcctcgtccccattgctcaaggggaagatgtaggcatttcatctgagccgggttggcaaggtggaattgtggcagaagcagaagttctaaagtggcgaggtaaggtctggcaagaaaggccgtttgaccttcatttctatgacagtttccccgtaggtttttcccaggagccgagcaggtgtttctggcattctcgtcaggaggttcgggcatgtacggcaggtggttccagtctgtccaggatgtggttccggcgtgtctggcacgtggttctggtacatctcagaggtggttccggcatgcccagccggtgatcccatagagtccaccaagtgattctggcgtaaccggcaggtgatttgtgcgtgtccggcagggggttctggcgagtcgagcaggtggttccggcgtgctcggcaggtgcttccggtgtcattggcacgtggttctggcatgtctgagaggtggttccggcatgcctggcaggtgattccggagtgttcgccaagtggttctggcgtagccggcatgtcctgcggtggttccagcgggtcgagccggtggttctggcgagtccggcaggtggttgcggtctgtccggcaggtggttctggggtatccggcacgaggtactggaacgtctgagatgttgtgccagcatgcccttcacgtgattctggcttgtcccccaagtggttctggtgtagcgggctggtgactttgtcgtgtccggcacctgggtcctgcgagtcgagcaggtggttcggcgtgctcggcatgtggtccacgggtgtccggcaggtggttcgagtctgtccagaacgtggttccagcgtgtcatgcaagtgcttctgttacgtctgagaggtggttcctgcaagcccggcaggtgattccggactgtccgccaggtggttcccacatagccagctgttgattttggcctgtccagcaggtggttcaggtgagtcgagcaggtggctccggcatgctcgacagttggttcaggcaggtcaggcacgtggttccggtctgtctgggaggtggttccggcgtgtccggcacgtggttccggcacgtctgagaggtggttctatcatgcctcgcaggtgtttccagagagtccaccaagtggttttggcgtagccggcaggtgattttggcgtgtccggcaggtggttcaggcgagttgagcaggtggttccaacgtgctcggcaagtgcttccggcgtctccggcacgtgtttccggcacatctgacaggtggttccggcatgcccgaaaggtgattccggtcggtccgggaggtggttccggcgtgtgcggcacgtggttctggtacgtgtccgaggtggttgcgcacgcccaacaggtgattctggactgtccgccacgtggttctggcacttctgagaggtggttctggtatgccaggcagttgattccggagtgttgggtaagtggttctggtgtagccggcagttcattttggcgtgtctggcacgtgggtcctgtgagtcgagcaggtggttccagcatgctcggcatgtgcttctgctgtcattggcacttggttctggcatgtcttagtggtggctccggcattcctggcatgtgatccaggagagtccgtcaagtggttctggcatagcctgcaggtgttttaggtgtgtcccgcaggttgttctggcgagtcgagcaggtggttccggcgtgctcggcaggtggtttaggcaggtgcgttaggtggttccggtcagtccgggaggtggttctggcgtgtttggcacgtggttccagcacgtctgacatgtggttctggcatgtccagcaggtgactccggattgtccaacaagtggttcttgcgtagccggcaggtgattttggcatgtcccacaggtggttccgacgattcgagcaggtgcttccggctagctcggcaggtgcttctggcatctctggcacttgattgtggcacatttgagaggtaggtccggcatgcccagcaggtgattccagaaagtccggctagtggttctggcacagccagcaggtgattttggcatgtgtggcaggtgggtcctgcgagtcgagcaggtggttcctgcatgctcagcaggtggttccgttgtgtctggtaggtaggtccggcgtgtgcagcacatggttctgctacgtctgagagttggttaccgcatgcccagcaggtgattccggactgtccgccaggtggttctggcacatctgagaggtggtaccggcatgcccggcaggtgaccccggagagtcctccaaggggttctggcctagcccgcaggtgattttggcgtgcccggcaggtggttgcggcatgctcggcaggtggttcaggcaggtgcggtaggtggttccggtcagtccgggaggtggttccggcatgtccggcacgtggttccggcacgtctgacagctggttctggcatgcccggcagttgatcccggagagtcctccaagtgattctggcgtagcccgcaggtgattttggcgtgtccggcaggtggttccggcatgctcggcaggtggttcaggcagttctggcatgtggttccgttgtgtccggtaggtggttccggcatgtccggcacgtggttctggcacgtctgactggtggttctggcatgacagcaggtgattctggagtgtctgttgagtggctctggcgtagcctgcaggtgattttggcatgtccagcaggtggttctggggagttgatcaggtggttccggcatcctcgacaggtggttccggcgtgtccggcacatggttctggcacatctgagaggtggctccggcattcctggcatgtgatccaggagagtctgccaagtggttctgacatagcccgcaggtgttttaggtgtgtccagcaggtggttctggcgagtcgagcaggtggttccggcgtgctcagcaggtggttcagtcaggtccagcaggtgtttgcagtctgtccatgacgtggttccggcatgcccggaaggtgattctggagtatccaccaagtggttttatcatagcccgcaggtgattttggcgtgaccggcaggtggttccggcgtgcttggcaggtggttcaggcatgtccggcaggtggtgccggtctgtccgggaggtggttccggcgtttaaggcacatggttccggcatgtatgagaggtggttctggcatgcccagcaggtgattccggaaagtcctgctagtggttctggcatagccagcaggtgatttttgcgtggacggcaggtgggtcctgcgagtcgagcatgtggttcctgcatgctcagcaggtggttcaggcgtgtccggcacgtggttctgggacgtgtgagaggtggctatggcatgcccagccggtgattccggactgtccgccacgtggttctggtacatgtgagaggtgtttccggcatgcccggcaggtgattccacagtgtccttcaagtggttctggtgtagccagcacgtgattttggcgtgtgaggttggtggttccagcgagtcaagcaggtggttctggcgtgctcggcagttggttcaggcatttccggcaggtggttccgggctgtctggacggtggttctggagagtcgagcaggtggttccggattttttggcatgtggttccggtgtgttcggtaggtggttccggcatgtccggcacgtggttctggcgtgtctgagaggtggttgcggcatgcccggcatgtggttcctgagtgtccgacaagtggttctggcatagccgactggcgattttggcttgtccagcaggtgtttctagcaagtcgagcaggttgttccggagtgctcggcaggtggttccggtctgtctgggatgtggtgccggcgtgtccaacatgtggttctggcatgtctaagacgttgttccagcattccctgcaggtgattccagagtgtcctccatgttgttttggcatagccggcaggtgattatggcgtgtccggcacatggttccacctagttgagcaggttattctggcgtgctcggcatgtgcttctggtctgcttgggaggtggttctggcatgtcaggcatgtggttgtgacacgattgagaggtggttcctgcaagcccgcctgtgattctagagtgtccaccaagtggttctggcatagccggcaggtgattttggcatgtccggcaggtggttccgccgagttgactaggtggtcccggcatgctcggcaggtggttcaggcagttctggcatgtggttccgttgtgtctggtaggttgttccggcgtgtccggcacgtggttctggcatgtctgagaggtggttccggcatgcccggta

SEQ ID NO: 88 - DNA, 2834 bp, Equus caballus
aggtggtttctggcatagccccggcagtgtgttctttggtgtttcccgccaggagggttctggtgagttcgaaccaggtggttccgggcgtgctcggccaggtggttcaaggcaggttccagcaagtgtttgcagtctgtccacgatgtggttccggcatgcccggaaggtgattcccggagtgtccggcaaggtggttctgacatagccggctggtgagtttggcgtgtcccagcagctggcttctgcgagttgagcagggtggttccagggtgctcagcaggtggtttccggtgggtccggcaggtggttccggtctgtccagtaggtggttccggcgtgtccggcacttgtttccggcacgtctgagaggtggttccggcatgcccggcgggtgattccatagtgtcctccacgtggttctggcctagctggcaggtgattttggcatctccggcacgtggttccggcgagtcgagcaggaggttccggcatgctcggcaggttcatccggtgtctctggcaagtggttctggcacgtctgagaggtggttccggcatgtccaacaggtgattctggagtgtcaggcaagtggttctggcgtagccgacaggtgatttttgcgtgtccagcaggtagttccggcaactcgagcaggtggttccagcgtgctcagcaggaggttcaggtgggtccggcaagtggttctgggtgtcccggaggtggttccggcatgtccaggacgtggttctggcacgtttgagaggtggttctggcatgcccgacatttgattccggagtgtctggcaagtggttctggtgtagccggcatgtgatttggcgtgtccggcaggcggttttggcgtgtccggcaggtgattttgacgtgtccggcaggtgtttctggcaagctcttcaggtggttccggtgttctcagcaggtgattccggtatgtccggcagctggttccggtctgtccgggagtgggttccggcgtgtgccgcacgtggttctggtacgtctgagaggtggttcccgcatgcccagcaggtgattccggactgtctgccacgtggctctggcacatctgagaggtggtacgggcatacccggcaggtgaccccggagagtcctccaaggggttctggcctagcccgcaggtgattttggcgtgtcctgcaggtggttgcggcatgctcggcaggtggttcaggcaggtgtggtaggtggttccggtcagtccaggaggtggttccggcgtgtccagcatgtggttccggaacgtctgacagctggttctggcatgcccggcagttgatcccggagagtcctccaagtgtttctggcatagccctcaggtgtttttggcttgtccggcaggtggttccggcgtgctcggcaggtggttcaggcatggccgggaggtggttccagtatgtgcagtacatgtttccaggttgtctggcatgtggttctggtacgtctgagatgtggttccggcatggctttcaggtgattccggactgtcccccaggtggttgtggcatagccagcagttgattttggcctggccggctggtggtccccgcgagtcaagcaggtggctccggagtgctcggcaggtggttctggcgtgtctggcaggtggttccgttctgtcctgtaggtcgttccggcatgtccggcatatgcttctggcacgtctgagaggtggttgtggcatgccaggcacgtgattcgggagtgtccgccaagtggttctggcgtagccggcgggtgcttttgtcgtctccggcatgtggttgaggcacctctgagaggtggttcctgcatgcccggcaggtgattctggttgcccgacaagtggttgtggcgcagccagctggtgattttggcgtgtccggcaggtggttctggcgagtcaagaaggtggtcccggcttgtccggcaggtggttccggtctgtgctggaggtggttcccgcgtgtctggcacgtgcttcttgcacgtctgagaggttgtgccgtcatgcccaaacagtatcccggcttgtacgcaaagtggttctgacatagacggtaggtgcttccggcgagtctggcaggtggttccgggctgtctggtaggtgcttccagggtctacggcacgtggttcgggcacctctgagaggtggttccggcatgaccggcaggtgattccggagtgtccgacaagtggttgtggcgtagcatgctagtgattttggcgtgtccggcaggtggttctgcggagtggcacaggtggttctggcatgctcggcacgtgcttccggcatctccggtatgtggttcttgcacgtttgagaggtggttccggcatgaccggcatgtgattccggagtgtgtgccaagtggttctggcgcagcgggcaggtgattctggcgtgtccggcaggtggttccttgggagtggatcaggtggttccggcaggcccggcctttgaacccggactgtcaggcacgtgcttctggcatacccagcaggtgattttggcatgtcagggatctggttacggtgagtcgagcagttggttccggcgtgctcagcagatggttccggtatgtccggcaggtggttccagtctgtccggtaggtggttccggcgtgtacggcatgtggttgtgggacgtctcagaggtggttgcgcatgcccaacaggtgatttcggactgtccgccacgtggttctggcacgtctgataggtggttccggcatggcctggcaggtgattccggactgtcccccaggtggttgtggcatagccggcagttgattttggcctgtccagcaag

SEQ ID NO: 89 - DNA, 4083 bp, Equus caballus
gacatgccggaccagctctcagacacaccagaaccacgtgccggagactccggaagcacctgccgagcatgccttagccacctgctcgactcgcaagaaacacctgctggacacgccaaaataccctgccggctatgccagaaccacttggccgacacttcagaatcacctgccgcgcatgccggaaccacctctcagacgtgctggaagcacgtgccggacacgccggaaacacctaccacacagaccggagccacctgccagacatgccggaaccacctgccgagcacgccggagccacctgctcgactcgccggaaccacctgccagacacgccaaaatcaactgctggctattcgagaaccacctggtggacagtccgcaatcacctgcctggcatataggaaccacctctcagacataccagacccacatgccggagacgctggaaccacgtcctggacagactggaaacacctgccagacacacctggaccgcctgctgagcacgccggaagcacctgcttgactcgcaggacacacgagccagacaggccaaaatcaactgctggctacaccagaaccactcggcagacactctggaatcacctgccgggcatgcaggaaccacctctcagacgtaccagaaccacatgccagacacgctggaaccacgtcctggacagactggaaccacctgccggacacgcctggagcgcctgccaagcacgccggaagcacctgcttgactcgcaggacccacctgccggacacgccaaaatgaactgctgtctatgccagaaccacttaccggacactctggaatcacctgtcggtcatgccggaaccacctctcagacatgccagaaccacatgccaattacaccggaagcacctgccgagcacaccggaaccacctgctcgactcgccagaatcacctgccggacatgccaaaatcacctgccggctacgacacagccagttggtgaactcttttgaatcacctgccgttcttgctggaatcacctcctggtcacgccaaaatcacctgccaactacgccacaaccacttggcggacactccagaaacacctgtcgggcaggccggaaccacctctcagacgtaccagaaccatgtgcctgagaggccggaacgacctaccggacagaacggaaccacctgtcagaaacgccaggaccacctgccgaacaagccggagccacctgctcgactcgccggaaccacctgccggacatgccaaaatcaccagccggctacgccacaaccacttgtcgggcaaccggaatcacctgccagccatgccggaaccacctctcagaggtgcctcaaccacatgccggagacgacaaaagcacccgccggctacgccagaaccacttggcggacactccagaatcacctgccgggcatgccagaaccacctctcagacgtgccagaagcacatgccggacatgccggaacgacctacaggacagaacggaaccacctgccagacacgccggaaccacctgccgagcacgccggaaccacctgctcgactcgcggtaaccaccagccggccaggccaaaatcaactgccggctatgccacaaccacctgggggacagtccggaatcacctgaaagccatgccggaaccacctctcagatgtaccagaaccacatgccagacaacctggaaacatgtactgcacatactggaaccacctgccggccatgcctgaaccacctgccgagcacgccgaaaccacctgccggacaagccaaaaacacctgagggctatgccagaaacacttggaggactctctgggatcaactgccgggcatgccagaaccagctgtcagacgtgctggagccacgtgccggacacgccggaaccacctcccggactgaccggaaccacctaccgcacctgcctgaaccacctgccgagcatgccgcaaccacctgcaggacacgccaaaatcacctgcaggctaggccagaaccccttggaggactctccggggtcacctgccggggatgcccgtaccacctctcagatgttccagagccacgtggcagacagtccggaatcacctgctgggcatgcgggaaccagctctcagacgtaccagaaccacgtgcggcacacgccggaacccactactggacagaccggaaccagctgccagacatgccggaatcacctgctgagaacgccggaaccacctgaacagcttgccagaaacacctgccggacacgtcaaaatcacctgccggagacgccaaaaccgcctgccggacatgccaaatcacctgccggctacaccagaaccacttgccggacactctggaatcaaatgttgggcatgccagaaccacctctcaaaggtgccagaaccacgtcctggacatgccggaaccacctccgggacacccagaaccacttgccggacccacctgaacctcctgctgagcacgctggaaccacctgctcgagttgccggaactacctgcccgacacgcaaaaatcacctgtcggctacgccagaaccacttgcctgacactccagaatcacctgtcggacatgccggaaccacctctcagacgtgccagaaccacgtgccagagacaccagatgaacctgccgagcatgccggaacctcctgctcgactcgccggaaccacgtgctggagatgccaaaatcacctgccggctaggccagaaccacgtggaggacactatggaatcacccgccaggcatgctggaaccacctctcagacgtgccagaaacaagtgccggacacgccggaccacctactggacagaccggaaccacctgccggacccaccggaatcacctgctgagcaccctggaacaacctgctcaactcgcaggagccagctgatggacacgccaaactcaccagccggctatgccagaaccacttgccagacactccggaatcacatgccaggcatgccggaaccacctctcagacgtgccagaaccacatgtcggacactccggaatcaccttccgggcatgccggaaccacgtcgtggacagactgcaaacacctgccggacctgcctgaaccacctgccaagcacgccagaaccacctgttcaactcaccacaacctcctgccggacacaccaaaaacacctgcgggctattccagaaccacttggcggactctccgggatcacctgcagggcatgccggagccacctctcagtcgtgtcagaaccatgtactggacacgccagaaccacctgccgaggatgccggaaccacctgatccactcctcagaaccaccttctggacacgacaaaatcaccttccggctagaccacaaccactcggcagacgctctgaaatcacctaccgggcatgccagaaccacctctcagacgtgccagaaccacgtgccggacacgccggaacaacctaccagacacaacggaaccacatgccagaactgcctgaaccacctgccgagcatgccgagaccacctagtcaactcggcggaaccacctgccggacatgccaaaatcacctgccggctatgccagaaccacttggtggacactctagaatcacaggcgggcttgcaggaaccacctctcaatcgtgtcacaaccacatgcctgacatgccagaaccacctcccgagcagaccagaagcacatgccgagcacgccggaataacctgctcgactcggtggaaccatgtgccggacacgccataatcacctgccggctatgccaaaacaacatggaggacactctggaatcacctgcagggaatgctggaacaacgtcttagacatgccagaaccacatgctggacacgccggcaccacatcccagacagactggaaccacctgccgagcactccggaacgacctgctcgactcgctagaaccacctgctggacaagccaaaatcgccagtcggctatgccagaaccacttgtcggacactccggaaccacatgccgggcatgccggaaccacttctcagacacgccggaaccacgtgccggacatgccggaaccaccta

SEQ ID NO: 90 - DNA, 8048 bp, Equus caballus
ggtatgccagacccactttccgactttcctaccccctggcggcctgccgcaccacctgctcagcacgcttgaccacgtgttttcttgcttgaactcctgctgaccacattgaacctacatgccaaaaattctggaccacctgctcgattctccagaaccactgcccagacagacccggaaccacctgccggaaatgcctgaaccaactgccgagcacgccagaaccacctgcttgactcgctggaatcacctacgtcacacgccaaaatcacgtgccggctacaccagaaccacttgaaggacactgtggaatcacctgctgggcatgccggaatcacctctcagatgtaccagaaccacgtggcggacagtccggaatcaccggctgggcatgccacagccacctctcatacatgccggaaccatgtgccctaaacgccagaaccacctcccggacagaccggcaccacctgccggacatgcctgaaccacctgccgagcacgccagaaccacctgccggtcacgccaaaatcacctgcgggctatgataaaaccacttggtggatactccagaatcaccttccgggcatgccggaaccacgtcatgggcagactgcaaacacctgctggacctgactgaaccacctgccgagcacgccggaaccacctgctcgacttgccagaaccacctgccggacacacctaaaacacctgcgggctatgccagaaccacttggcagactctcctggatcacatgccaggaatgccggagccacctctcagatgtgccagaaccatgtgccggacacgccggaactacctgtcgaggatgccggaaccacctgatccactccccagaaccacctgctggacatgccaaaatcacctgctggctacgccagagacactcaacagacactccagaatcacctgccgtcatgccagaaccaccagtcagacgtgccagaaccacgtgccggacatgccggaaccacctaccggacacaacggaaccacatgccagaactgcctgaaccacctgccgagcatgccggaaccacctgccggacacgccaaaaacacctgcgggctacgccagaaccacttggaggactctccgggatcaactgccgggcatgccagaaccagctgtcacacgtgccggaaccacgtgccggacatgccggaaccacctcccggactgaccggaaccacctaccgcacctgcctgaaccacctgccgagcatgccgcaaccacctgccgggcacgccaaaatcacctgcgggctaggccagaaccccttggaggactctccggggtcacctgccgggcatgccggtaccacctctcagatgtgccagaaccacgtggcggacagtccggaatcacctgctgggcatgcggcaaccaactctcagacgtagcagaaccatgtgcggcacacgccggacctacctaccagacacaacggaaccacctgctgagcatgcaggaaccacctgctcgactcgcaggacccacctgccacacatgccaaaatcacctgctggctgtgccagaaccactagccggactttctggaatcacctgctgggcatgccggacctacctctcaaatgtgccacaatcaagtgccagagatggcagaagcacctgccgagctagccggaagcacctgctcgaatcgtcggaaccacatgtgggacatgccaaaatcacctgccggctacgcaagaaccacttgttggacaatccggagtcacctgctggacgtgccagaaccacatgtcagacgtgctggaaccacgtgccaaacatgccagaaccacctcccggactgactggaaccacctaacgcacctgcctaaaccacctgccgagcacgccggagccacctgctcgactcaccagaataacctgcgggacacacctaaaacacctgcgggctatgccagaaccacttgacggactctcctggatcacatgccaggaatgccggagccaccactaagacatgccagaaccaagtgccaatgacagcagaagcacatgccgagcacgctggaaccacctgctcgactcacaggacccacgtgccggacatgccaaaatgaactgccggctacaccagaaccacttacccaaaactccggaatcaactgcctggcatgccagaaccacctctcagacgtgccagaaccacgtggcggacagtccagaatcacctgttgggcgtgcgcaaccacctcggacacgtaccagaaccacgtgccgcacacgccggaaccacctcccggaccgaccggaatcacctttcgggcatgccggaaccacctgtcagatgtgccagaaacacgtgccggagacgccggaagcacttgccgagcacgttggaaccacctgctcaaatcgcctgaaccacctgccggacacgccaaaatcacctgccggctacgccaaaaccacttggtggactctctggaaacacctgcgaggcatgatagaaccacctctcagacgtgccggaaccacgtgccggacacgccggaaccacctcccggacagactggaaccacgtgcctgacctgcctgaaccaactgtcgagcatgccggagccacctgctcgactcacctgaaccacctgctggacaggccaaaatcaacagctggctatgtgggaaccacctggcggacagtccggaatcacctgccgggcttgcaggaaccacctctcagacgtaacagaaccacttgcatgacacgctggaaccacgttctggacagactggaaccacctgccggacacccgtggaccacatgccgagcacgccgaaccacctgctcgactcgcaggacccaggtgccggacacgacaaagtcacctgcccgcgacaccagaaccacttgggggtcaagccagaatcacgtgaagggcatgccggcacaacatctcagaagtgccagaagcacgtgctggacaggccggaaccatctcccagacagtccggaaccacaggaaagaatcgccggaaccacctgctttactcaccggtcccaaatgccggacatgccaaaatcacctgccggctacaccagaaccacttgcggcacaagctgcaatcacgtgaagggcatgccggcacaacatctcagacgttccagtacctcgtgccggacaccccagaaccacctgccggacagaccgcaaccacctgccggacacgccggaaccaccggctcgacccgctggaaccaccgcaggacatgcaaaatcacctgccggctacgccagaaccacttggcgaacactccggaatcacctgccaggcatgccggaaccacctctcagacatgccagaaccacgtgccaatgacaccggaagcacctgccgagcacgccggaaccacctgctcgactcgccagaaccccctgccggacacgcacaaatcacctgccggttacgccagaatcacttggtggactctatgggatcaccggctgggcatgccggaaccacctctgagatgtaccagaaccacgtgccagacacgccggaaccacatcctggacagactggaaccacctgccgtacatgcccgaacctcctgacgagaatgccagaaacacctgctcggctcctgggaaaaacctacggggaaactgtcatagaaatgaaggtcagacggcctttcttgccagaccttacctcgcgactttagaacttctgcttctgccacaattccaccttgccaacccggctcagacgaaatgcctacatcttccccttgagcaatggggacgaggcccggatgattgtggttccacatgctgaggaggagagagacaataggcttttaactaaccaccaagtgcaatggttgagagagtgtcagaaagcaccaactgcagaaagacccctttactctcagcagtgccctccattgctctagagcaggaaggcacaaaggactgcctcaatccttcaatgggaaacaagcaataaactgtcttgcttccagctctttaggaagctgagaaagaactcgctttccacagagctgttaaagcatacgaggaaacactcatacaaaggcagctcaaacgccatttcttcccagtgcttaactcgccgcattaagaattctgcttttgccgcaattccaccttgccaacccggcgagacgaaatgcctacatcttcccctgaagcaactggtctgtgtcccaaatgattgagcgtccacgtgcttaggaggtgatagacggcacgcctttttccaaccaccattgtgcactggtggagagagtgtcggaaagcagctatgtcagaaagacccctttgctctcagctctgccctccattgctctagacgtggaatgcacaatgcactggctcccccccttcaaggggcgacaagccacagaccatcttccttccatctctttaggaagctgagaaagaactcgcttacaacagtgctctttctgtgtcctggcaacacctcatacaaaggcagctgatatgccatttcttttcagcgcttaactcgccgatttagaacttctgcttctgccagatttccaccttgccaaccccgctcagacgaaatgcctacatcttccccttcagcaatgcggatgaggcccagatgattgtgcctccacatgtttagcaagagcagacaataggccttttacaaactgccattgtgcactggtgcagagagtgtcagaatgcgcttatgtcagaaagggccctttgctctcagccgtgccctccattgctctagaggtggaaggcacaaagcactgcctccatacttgaattggagacaagccataaactgtcctgcttccagctctttagaaagctggggaagcacttgcattcctcagtgctcttacagcatccagggaacatgtcatacaaagcagctgaatgccatgtcttttcagcccttaacttgccaatctgcaacatccgcttctgccgcatttccaccttgccaacccggctcagaagaaatgcctacatcttcccctttaagcaatggggacgaggcccggatgcttgtggttccacatgctgaggaggagacagacaataggcttttaaccaactgcccttgatcaatggttggggcagtgtcagaaaccaccaatttcagaaagtccttttactcttggtcttgccctccattcctctagaggtaggaggcacaaggcactggcaccacccctgaagggtatcagaaagcaccaatggcagaaagcccccttggctctcagccatgccctccattgctctgcaggtggaaggcacaaagcactgcctctttccttcaatgggagacaagccataaattgtcttgtctccagctctttaggaagctgagaaagaactcgctttccatagtgctgttacagcatacgaggaaactctcatacaaagtcagctcaaacgccatttcttcccagatcttaactccccgctttaggacttctgcttctgccacagttctaccttgccaaccttgctcagacgaaatgcctacatcttgccctgaatcaactgggctgagtcccaaatgatttagcatccacctgctcaggaggcgctagactgtaagcctttttccaaccaccattgtgcactggtggagagagtgtcagaatgcagctatgtcagaaagacccttttgctctcagccatgccctccattgctctagattggaatgcacaatgcattggctccacccctcaaggggccacaagccacacaccatcttccttccatatctttaggaagctgagaacaaactcacctgacgtataaaaaggaatcatgccccttatgtgccagaaaaccccgggaaacatgccaaaaacaccctccgcacactctcaaagggccacacattcatgccagtatgacccaacaggcataccagaagcacccacgttgcatgccagaaccacctgtaaccacctgccggacacagtgggagcagcgattctgacactgcagaaccatctcttcaacatgccagctgcacacaatgacatgacgggaccagattccaaacatagcacaatgacatgccagacatattgtaaacacctgttggatatgccacaaacaggtgacagaaaaccctgagaccagctgaggagtatgtaagaacgggggccagaaatgccacaagcatctgtcttacaagccagagccacgagcccaaaaagcaggaaagacctgccggacacaccaaaataacctgccggtgacgccagaaccacttggcggacacccaggaatcacctgctgggcacgcccgaagcacctcacagacgtgccagaaccacgtcacagagagtctggaatcacctgttgggcgtgtgcaaccacctctgagacggaccagaaccacgtgccgtacacgccggatccacctaccggacagaccggaatcacctttcgggcatgccggaactacctgtcagatgtgccagaacccgtgccggagacgccggaagcacctgccgagcacgtcagaaacaccagctcaactcgcctgaagcaactgtcggacacgcccaaatcacctgccggctatgccaaaaccacttggtggactctctggaatcacctgccgggcatgatagaaccacctgtcagacgggctggaaccacgttgcggacacgccggaaccacctcccggacagaccggaaccacctgctggacctgcctgaaccaactgtcgagcacgccggaaccacatgctcgactcgctggaaccacatgccagacatggcaaaatcacctgccggctatgccagaaccacttggcggacactccggaatcacctgccgggcatgccagcacaacctctcagaagtgccagaagcacatgccggacaggctggaaccatctcctggacagaccggaaacacagcaaacacttgcaggaaccacctgcttgactcaccggtcccacctgccagacacgccaaaatcacctgcccgctacaccagaaccacttgggggacaagccggagtcacgtgaatggcatgccgacacaacctctcagacgtgccagaacctcgtgccggacaccccagaaccacctgccggacagatcgcaaccacctgccggacacgccggaaccaccggttcgacctgccggaaccacagcccgacatgcaaaatcacctgccggctacgccagaaccacttggcgaacactccggaatcacctgctgggcatgccggaaccacctctcagacatgccagaaccaagtgccggagacgccggaagcaccttctgagcatgccggagccacctgctcgactccccagaaacacctgacagacacaccaaaatcacctgccaactatgccagaaccacctggcggacactccggaatcacgtgccgcacatgccggaaccacctctcagacgtgccggaagcacgtgctggacacgccggaaacacctaccggacagaccggaaccacctctcagacatgccggaaccacctgctgagcacgccggagccacctgctcgactcgctggaaccacctgccggacagggcaaaatcaacagctggctatgcgagaaccacctggcggacactccaaaatcacctgccgggcatgcaggaaccacctctcagatgttagagaaccacgtgccagacacgctggaaccacgtcctagacagactggaacaacctgctagacacgcctggaacacctgccgagcacgccggaagcacctgctcaacgcacagggacacacgtgctggacatgccgacatgatctgcgagctatccccagaaaccactttgcctgacactcccggaatcacttgcctggcatgccagaaaccacttttctgacgtgccagaaacatgtgccggaatatgccagaaacgacctatcggacagaaacggaaaccaacctgccagacatggtcagaaacacctggcgggaaaggcagaagacacctgcctggattcgcccgaac

SEQ ID NO: 91 - DNA, 1555 bp, Equus caballus
ggtagatggatcataggcagacggatgatgaacagacataatgggtagatagaccgacatggatggaggaggaacaaaggggaagaagaatagtttgattcattaaatagccgaatagaaaacataaaacatttctgcagagtcgaaaatagaaaacctaccctgtgtctgtgttgcgtgttgcgcgtgtgtgttgcgtgtcacgtgttgtgtgttgcgtgtgcccacagagagagagggaggaagcagagacacgcggatccatccaacagcagagggaacaatgtggacccggccgcgctgcccacgtggaaggtggtgactcacggtggacggccgacggaggaaccctggaggagagacaggactgaaggagtcctctcggcggctcacggcctaagtactaagcattggactaacagggaaggcccctaagtcccatctgggtgtccgtgaccccgggtgacccggctgccccatcacctccctccctcgactcctctcattctcccactcgcccctccaatcccagccacacagcccctttgctagtcctggcaccagccctgcatgttcctgcctcaggacctttgcatgggctgtggtcccacctgaaggcctttgcctggttctctgcctggttcacccttctcctgactcccacgtttaatcggaacttttcccacctcccagcgcgcatgctgggtcccactgactctatgccacttatgtattttttatttttttattattttattgaggtcataatggtttataactgtgtaatttcaggggtatgttattatatgtctgtttctgtgtagatggcgtcgtgctcaccaacaatactctaatttttatccatcaccagacatatgtgcccttaatcccttaggaccgcccccaacccccttcccgtctggtcaccactcatctgtcctgtttgtccgtgtgtctgtttatcttccacatacgagtgaaatcgtacagtgattgtctttctctgtctgactgacttcacttaacatcaggcctgcaaggtccattcatgttgtagtgaatgggatgattttatcctttttcagggctgagtagtattccattgtatatatatctcatatcttctttatccggtcatgggtccatgggcacttgggttgcttctgcgtcttggctgttgtgaataatgctgccgtgaatacgggggtgcataaatctctttaaattattgatttccagttctttgggtaaatacccagtcatgggatggctggatcatacagtatttctatttttaattttttgaggaagctccacctgtttcccgtggtggctgctacactaattatttttttcttcctgacgttgtccgtttgtccgtaatctgggcccttgtcgccccttctccacctctgcttcctccccagaaggcgagctccttatgggcagaaatctgggcctttctgctcagatgagtctaaacgcctagaccttggctcggggtggctgctgattgaatattcgagcctggaggtccccagatgcagcttgaggg

SEQ ID NO: 92 - DNA, 3101 bp, Equus caballus
atgatggatacaagacattgttgcaacaataggtgagacgcattattgcaatgatgggtgtgacattgtcagcaccatggagggaaacactgttgcaatgatgagatagacacattgctgcaaaggtggaagggacgcattatcctattgatgagtgcggccaattgcaatgacgggtgtgacacgttgttgcaatcatggatacaagacattgttgcaacaataggtgagatgcactgttgcaacatgggagggaaaccctgttgcaatgatgagactgacaccttgttgcaacgtcatgaaggaaagttgttgccacgatgagctgatctggacacacgttattaagcaaagtccacggtctccatgagcgttcatctcgctgtcggacactttatgggtttagacaaatggataatgccgcatacccaccattattttattgtgtagagtagtttcgctgccctaaaaatcccctttcctccacctatttatccccctctccccgaagcccccagcaaccacgggtcgtttcaccgtctcccaaagtttttatttttatttcttgagaatcattgattttttttttaatcgtcatgaaatccgcatcccgcgtaattcaccattttaaagcacacagtgtgcattgtgcacgcccacagcggtgcaaccaacacctctgtctggtttcagaacgttctcgtgaccccgagcggtaacgttgggcccacgagcaggccccaccgccctcctccggcccctggcactgatcatctgcttcagaattgaccgaaaaatggctcgtcagggcggccagaagcgaattctcccagttgagagcctggtctaaatttcagagggattctcatcggtttagtgtcaatcagcaaacacacgtggagcagaaacgtgaccccatctgtttggccgtctctcttcagacttcgaggcaggtgtccgcccggctgtgggtctggcggctccttgtggtgttggaggaggtgacgggggaggaaaagagaaaatcatttctgttctggccactttctcccccggagtctccccgtcagcagaatttcttatttcggtggcagttttccaggatgatggagacagcacgacactccctgatggccaggtcctcccgccaaaaaaacacaaaaatcatccacaaaagtccgactgtaaagaatgtcccctggggggatgccgccatctttttttttatatcgagtaatttgccttttttttttttggtgaggaagattagccctgagctaacatctgcggccaattctcctcttttctttgctgaggaagactggccctgggtgtgggaggaaggaaggtgcgtggatggactgaagggtggcctcccaaaaacatacgctgagtcgtgaccccaggacctcagaatgggccttatttggaaatggggtctttgcaggtctgatgaagggaaggatggagaggagggcttcctggaggaggcggccctgaatcaaggatggagaggagggcttcctggaggaggcggccctgaatcaaggatggagaggagggcttcctggaggaggcggccctgaatcaaggatggagaggagggcttcccggaggaggcggccctgaatcaaggatggagaggagggcttcctggaggaggcggccctgaatcaaggatggagaggagggcttcctggaggaggcagccctgaatcaaggatggagaggagggcttcctggaggaggcggccctgaatccaaggacagcgtcctcctcagagacagaagaggagacgcagacgcagaggagcagccccgtgaggatggaggcagagacgggagggaggcggccaccagcccagggaccctggagccccggacgctggaagaggcaggagggaccctccccgggagcctccggagggagcgtggccctgcgacccttgaccccagactccgggctccaggacgggggagggtggacccctggggttcaaactacccagtttgcaggattttgttccaggcgccctggggaccctaaggccctgataaggcctgcattccagccccacaagtcccgctcactccaccaccctgcgacccttgacctcacactctgggctccaggacgggggcgggtggatccctggggttcaagcccccagtgtggggtcaaatgtcacggccctcgggaccatctccagcctcagcccttgcgcctgattttagccccaaaaacctcctcctcctcctccgacggcctccagaaaaaaccctccggcggcaacaatgacgccccgcgtccgcgtggagacgcagtgtagccgcgcgcacttcctccccgtggatccgcctgccgcgtccaacagacacgcttcggttccacggtgaggactttccacccgcttgatggcctgtcctccaggcgccatctccaaacgctccccgtgcggggcccgcggcccccaaacggccctggagaaggattaagcgcctcggtggaatccggctgtttaaccagcaggtggctgttttagttacattgtatctttcagcctccgagagcgcatcttaaatgcactgattaggggccggcccggtggcgcagtggttaagtgcgcatgctccacttaggcggcctgggggttcgcaggttcggatcccgggtgtggacagggcaacgcttggcaaaagccatgctgtggtactcgtcccacgtgtaaagtagaggaagatgggcacggatgttagctcagggccagtcttcctcagcaaaaaaaaaaaaaaaaaaaaatagaggaggattggcaacaggtgttagctcatggccaatcttcctcaaaaaaatttttttaaacataaataaataaataaataaatgcactgattaacggctgcaccgtaagtgctcgtccgaggttgccacgcgcgctttccgtatttcagaaaattcatctgcctggggacccaggacgaacctgctgcgagcagggtcatgggagaggtccggatcgcagcccgaaattaagccggtgtcgtctctacccgcaaagcgcacatcgccttccacggagaaaaaaaaaagatgaaggatg

SEQ ID NO: 93 - DNA, 2059 bp, Equus caballus
tgggtacgttgtcagacatatttgtatcatttagatacaaaattgctaaattcttatacatagtgacataggtaagttgtcacacatatttgtaccacttatgttacaaaattgctaaattcttgtccatattcgcatacgtaagttctcatacatatttgcaccatttatgatacaaaattactaagttcttatccatgtttacgtgtgcaaattctcatacatatttgtaccacttacgatacaaaaattgctaaattctgtacactgtgtctacgtagcatccagaataaattctacccgttcttacaccgaattcttgtggatatttacctgtggaaattctcgtatgtatttgtatcattgacgagacaaaatttctaaattctttttttttttctgccctccgtctacccaatctatctcacaaattctcgcgcatattctcacactcaattacgacacatacattctgtgttttcgtagccacgtcctggctctttctttgtgtccctaacctgtgggtccgtcgtgcgagttttcctctttcctcggccgcgtttgcaaaagtacgatttctcgcacgacctctagattccctgtttctgcctcagaaattaactttactgcagatacggaatttctgacttattttaggaaaactaggtcttgcattttttttttttttacccgggaagggggtatgtttttcgtttcattgcatctagctttccgtgcacctttctcgcgtctgtgaattggggacgcccggggggtcagcaggtcacggcgcctcagggggtcccaggggtgtccgcgtcagagcccccagtgaccccgtgacccgggcaggcccccaccctcccctcgtctccccggggcccagagccacgggtttgcacaacctccaaccacactcgacgcacgcgcgaggcggccgaaatcaatgcaaaaaatcagctggcgttgccttgagaggtgttggtaaaataaaaaacatccgcaaagacccccccaaaccatcctcattttcatgctcgtggtaccccaagctctcgactccgacgattgctgaaagtcagaaaaaacagcgtcgtctaaatgctatttgcatgcacagcatctttctttttagggcccagaagacctgggatgggcccgtcccgtttcatcacacttgtggtttttttttttttttatggttttaataataaaatggagaaactccatgagaattagtaggaatcaaccccagagggagagtttcgtgcaaaacttgaacgtacgtatctgttctcgttattatatgacatcgcgtatacgggggacgatcattgaaaaggaattcctcttttttttttttccttctcctcaatgtctagccgcatcgtttgtggacgaagacatcgccgcctgcagatcgcaaatgttaattttgtcaccgaagcgttccttaattcttagcatcctgggtccgcttgccggggaaagatggaaacaaatgggttgcaggaggagccgcaatatttttagcggctgtaaagtgaatgtgcaacagctgtgtcacggatacagcgtagcaaattcgggggaagaagaattagggctggtgaaaggcataccatgtagcaaatttggcagaagaggaaaaggggctgatgaaatggatacaaggtaacaaatttggcagcaagggaacaagggctggtggaagacggatacaatgtaaaatttggcagaaagaggaaaaagggctggggaaatggatacaatgtcacaaatttggcaagagggaaaaagggctggcgaaatggatacaatgtagcaaaattggcagcagggaaacaagggttggtgaaaaagtggatacaatgtaaccaattcggcagaaaagggaaaagggctggtgaaaggatacaatgtagcaaatttggcggaagagggaaaagagctggtgaaacagatacaatgtaacaaatttgtcacaaagggggaaaaagaggtggtgaaatggatacaatgcagcacagttggcagaagaggaataagggctgtggaa

SEQ ID NO: 94 - DNA, 1671 bp, Equus caballus
tggacccagtgtagacactccctcctgtggccaggttccgatcctgtctacacggtcggctccagggtgagtgtggccaggaggagcccggtcttcactgcccggggctgtatttccctcgacaggcagtgtggacgaaactcgggagaaacccccccaatcgggaaaagtcaaccttctctctctttttttttttttctctcagagccgcacccaaccccctgaatacccgatggtgagttagaactctgaccccgagtgtccgcccggagctggagccggtgttagtcaaacgggcacgcgcaccacggggtggggaaggcgctgaaaaccggggctgggggcgctctcgggttttgtgcagtcaacaacgtgggcgcacgtccatggtctacactgctggggcccgaccttgatccacttgtcacgtcccactgggtgaaatttgtcccgttcctcgtaccccgtggacccgcccgtcctcttcctcttgcgtccgtgtcggcccccaaaatacccctttgagtatcgagattatttcgtccttcaaggcccctcgggtttccagacgggacccccattcggcgccacgagcatgactggggggaaagtggatttggatccttcttccgtgtccgtcgtgccatttattatttttttaaacccacccccaattccgtgttttctgaacccagaggatcgaggtgccgggcgactcgcagaatcaatacattttcccgagtctggagcccagaccgaagcacacggtgaagatcaggacgggggacgcccgggacgcccaggacccgcgctggggcgcctggagccggcccgtcgagttcggtaggaattctcctttttttttttttttttttggctgaggaagattggccctgagctcacatctgctgccaattctcttttttttttttttttttttgctgaggaagattggccctgagctcacatctgctggcaattctcctttttttttttttttttttttgtggtatttgaagacggcgggtttgcagctgcgatgaaggtcaggattttctttaaggcttcctggaggaggcggccctgaatcatggatggagaggagggcttcctggaggaggcggccctgaatcaaggatggagaggagggcttcctggaggaggcgcccctgaatcaaggatggagaggagggcttcctggaggaggcggccctgaagcatggatggagaggagggcttcctggaggtggcggccctgaatcaaggatggacaggagggcttcctggaggaggcggccctgaataaaggatggagaggaagcttcctggaaggaggcggccctgaaataaaggatagaagagaagagcttcctgtaggacgccgacccatgaattcaaggatgaggaaggaagggcttacttggaggaggcgggtgggaacttactcccgaaaaagagccaagccgcaccccggcccgagcggaccccgggacgaccccaagggacgggagctttggggacgtaccatattgacctccagcctggacctcaggaaaataaccaggagatacacacctcgttgatatgtgagttggaaaagaataagcaacagggaggtgacggacacatacccctggacccccccaaaaagccctcgatatggttgctttc

SEQ ID NO: 95 - DNA, 1933 bp, Equus caballus
ccccccaggaaaaaaaaaaaaaaaatctggaaaataactccaactgcaaatccgcggcccccgggccttctcgaaggacgttgcgataattgaagcgttttctttttagggtttccgctttcgctccgcatttccaccccccggggctctccctccctctgaccctttgacctcatgtccatgcggacgtcccgtcttctcctgggcggatctgctatcagtcactcacactttagtacgaattggttgccttctccttcttaacggtgagcgtccacggtctggttttccgctcaaaggcggtttaaacgcggagggagggggcgctgggggtgattttttcgggggtttcggtggacgttttttggtgccccggaaataacccacgaaaaaagaaattttgggaaaatgacacctcctggtctgtccccgtccaacggggcctccaacacgagtcattttcaccgaaatcacaggaatttgttcccgatgaggaggcttgcgccgtgtgcacaggggcgctgggaccacccgggtggcaggggccttaaaacaggaatgacccttgccctcgtcctgggtggcccccccccagcgggttccggggggctctggggtcagagggcgtgggatggtgtgtcccccaggggagtccagggcaaaggtcgtgacccgcatcccccggggtcagatggacggaggcgcgtcctctggttttggccgcaaaagcgggcggaccgcgtgtccggacccccacatctggggtcttgggggcccggggagcggacggcgtcccacactgcgttcgcactaccaccaccctgcacggggcggcttctcccagctgcgtccgtgggaccatgcgggggtcacgtgggtccccccaaagccccgtccctggggtgtccggggaccccagaccggggggcggctgggccccttttgggagcaggtccggccgcctcctccaggaagccctcctctccatccttgattcagggccgcctcctccaggacgccctcctctccatccttgattcagggccgcctcctccaggaagccctcctctccatccttgattcagggccgcctcctccaggaagccctcctctccatccttgattcagggccgcctcctccaggaagccctcctctccatccttgattcagggccgcctcctccaggaagccctcctctccatccttgattcagggccgcctcctccaggaagccctcctctccatccttgattcagggccgcctcctccaggaagccctcctctccatccttgattcagggccgcctcctccaggaagccctcctctccatccttgattcagggccgcctcctccaggaagccctcctctccatcctggattcagggccgcctcctccaggaagccctcctctccatccttgattcagggccgcctcctccaggaagccttcctctccatcctccccttcatcgcagctgcaaacaccccgtctgcaaataacacgccgatctgaggtcctggggtgacgaggtggacctgacctttgggggggacggggttacaccccaaacagcccccttaggacgagtccctgtcccctcacaccctgcgggagcccctaccccccagccgagccccactctgcctccaggctccacctgctcccccgccacccccattccatccacttcctcccggagtcggtcaacaaacatctcttcctcccgaagtcagtcaacaaacgttccttcctgaaaaaaaaaaaaaaaaccggccaacagacgttttaggctccgagtccacccgtgtccacccctccatcgcccctccctcggcccggtgacgtcaccccccgcctcgctgggcgtcctggtcccgcaggcgcgccgagtcgtggtcttcctataaagggacccacatgtcgggagat

SEQ ID NO: 96 - DNA, 4165 bp, Equus caballus
tgcagggcatgacagaaccacctctcagccatgccagaaccacatgccagagacacccagatgcacctgctgagcacgccagaacctcctgctcgactctaccggaaccacctgacggagatgccaaatataacctgccggccagaccagaaccacttggcgcaatctatggaatcacacgctgggcatgccggaaccacctctcagacatgccggaagcacgtgctggacacaccagaaccacctcccggactaaccggaaccacctttcggacatgcctgaaccaccttaggagcacgctggaaccacctgctcgactcgctggaaccatctgctggatacaccaaaatcacctgccggctacaccagaaccacttgccgacactccggaataacctgccattcatcccggaacctcttgtcagatgtgccagaaccacgtgctggacgccccggaccacttccgtgaaagactggaacaacctgctgagcattccggaaacacctgctcgactcccgggaaccgcctgtggggaaactgtcatagaattgcaggtaaaacggcctttcttgccagcccttaacacgccactttagaccttctgcttctgccacaattgcagcttgtcaacccggctcagacgaaatgcctacatcttcccctgaagcaactgggctgagtcccaaatgattgagcgtccacgtgcttaggaggcgatagactgcacgcctttttccaaccaccattgtgcactgctggagagagtgtcggaaagcagctgtgtcagaaagacccctttgctctcagccgtgcccagcattgctgtagacgtggaatgcacaatgcactggctccccccctcaaggggcgacaagccacagaccatcttccttccatctctttaggaagctgagaaagaactcgctttcaacagtgctctttctgtgtcctggcaacatctcatacaaaggcagctgatatgccatttcttttcagcgcttaactcgcagatttggaacttctgctcctgccacatttccaccttgccaacccaggtcagacgaaatgtctacatcttccccttaagcaactgggctgagcctgaaatgattctgcaaccatgtgtttagcaggagagagacaatacgcttttcaccaaccacagttgacccctggtggagagagtgtcagaaaacacctatgtcagaaaggcccctttcctctcagttttgccctccattgctttagacgcggaatgcacaatgcattggctccacccctcaaggggcgacaagccacagaccatctttcttccatctctttaggaagttgagaaccaactcacctgacgcataaaaaggaatcatgccacttagatgccagaaaaccccgggagacatgccaaaaacaccctccgcacactatcaaagaaacacacattcatgtaagaacgacccaacaggcacaccagaagcacccacgttgcacgccagaaccacctgtaaccacctgctgaacacagtggaacaacaattctgacactgcagaaccatctcttcaacatgccagctgcacgcaacagacacgacggaaccagcacctgccgagcatgcctgagccacctgctcgactcgcaagaaacacctgccagacacgccagaatcccatgccggctatgccagaaccacttggctgacactccagaatcacctgcctggcatgccagaaccacctctcagacgtgccagagcatgtgccggacatgccggaatgaccaaccggacagcacggaaccacatgacagacacgccagaaccacctgctgaacaagccggagccacctgctccactcgccagaaccacctgcctgacacgccaaaatcaactgctggctatgcgagaaccacctgggggacagtccgcaatcacctgccgggcttgcaggaaccacctctcagacgtaccaggaccacctgccggacacgccaaaatcacctgccaactacgccagaaccacttgacggacactccggaaacacctgtcgggccggccggaaccacctctcagacgtgccagaaccatgtgcctgagatgccggaaccacgccccgaacagactgaaaccacctgccagacacgccggaaccacctgctcgactcacctgaaccacctacctcacacgccaaaatcacctgccgggtatgccagaaccacttggcggacactccggaatcatatgccggacatgccagcaccagctctcagacacaccagaacaacgtgccggagacgccggaagcacctgccgagcatgcctgagccacctgctcaactcgcaagaaacacctgccggacatgccaaaatcccatgccggctctgccagaaccattggcccaacttttcagaatcacctgccgcgcatgccggaaccaactctcagacgtgccagaagcacgtgccggacatgccggaatgacctaccggacggaacggaatcacctgtcagactcgtcggaaccacctgcggaacaagccggagccacctgctcgattcaccggaaccacctgccggacaggccaaaatcaacagccagctatgccacaaccacctgggagacagtccggaatcacctgccagccatgccggaaccacctctcagacataccagaaccacatgccggacaagctggaaacgtgtactgcacagactggaagcacctcacggccacgcctgaaccacctgccgagaacgccggaaccaccttccggacacgccaaaatcacctgctggctatgccaaaacaacttggcgacacttcggaatcacctgccatgcattccggaaccacctctcagacgtgccggaagcacctgccggacacgccaaaatcaccttccggctacaccagaaccacttggtggacaattcggaatcacctgccagtcatgccggaaccacctctcagaggttccagaaccatgtgccatagatgctggaaccaccaaccggacagcccagaaccacctgccagacacgccggaagcacctgccggctacgtcagaaccaatttgcatacatgcgggaataatgtttcaggcatgacggcacaacctctcagacgtgccagaagcactggccggacacgcgggaaccacctgcagcacacaccggaaccacctgacggacacgccgggaccacctacttgactcgccagaaacacctgccggacacaccaaaatcacctgccggttacgccagaaccacttgacggacactcctgaatcacctgccgagcgtgccagcacaacccctcagaagagccagaagcacgtgctggataggccggaaccatctcccggacagaccggaaccacaggaaacactcgccggaaccacctgcttgactcaccggtcccacctgccgtacatgccaaaatcacctgcccgctacaccagaaccacttggcggacaagccggaatcacctgaagggcatgccggcacaacctgtcagacgtgccagaacctcgtgccggacaccccagaaccacctgccagacagaccggaaccacctgccggacatgccgggaccaccggctcgactcgccggaaccacctgccagacacaccaaaatcaactgctggctatgcgagaaccacctggtggacagtccgcaatcacctgccgggcatacaggaaccacctctcagaagtaccagaaccacatgccggagacgctggaaccacgtcctggacagactggaaccacctgccagacacgcctggactgcctgccgagcacgccagaagcacctgcttgactcgcaggacccacctgccagacacgccaaaatcaactgctggctacaccagaaccacttaccggacactctggaatcacctgcctggcatgccagaaccacctctcagacatgccagaaccacatgccaattacatcggaagcacctgccgagcacgccggaaccacctgcttgactcaccagaaccacctgccggacacgctaaaatcacctgccgcctacgccacaaccagttggtgaacacttcggaatcacctgccgggcttgctggaaccaccggaccgtcacgccaaaatcacactgccaacttcgccagaaccagttggcggacact

SEQ ID NO: 97 - DNA, 3045 bp, Equus caballus
ggatagattgatggatggatggatggatggatggatggatggatagatggacggatggatggatggatagatagatggatggatggatagattgatggatggatggatggatggacagatggacggatggataggtggatcgatagacagatgaatgattgatccatgattgatagatcatagatggaatggatgatggatagatagggcgggggccggagggcccggctggctgtcgacccccgtctatcgatcatctatcatctaatctatgtatccgcctgcctacctatccatcatcatcagagttccgtgtgctgcgtccacaccgcgtgcgcctgtgcgcagacgccgtgtggctttccaggctcttcccccggagtccagctttgcagaccgtgacacgcagaagggaaaaacccgcttcgtggggtgtgggtcgcgctggcgccccgtgggaccctcccgccgtgcttgtgtcgctgcagattcgtgccaggagcagaggctgttcccgcgcttcgtgttgatctcgggcgcggtggcgttcctgacggtggtcctcctgctcgtgtccttgtggaagctgcgcaggtgaggacgccccccgggcctcgtcctcacaccctcactaacccggatgcgggcgcggggatcccaacacgcccggacccggacttgggggcacaggagcgctgtcgggtcccggagtgcagcacagcatcgcgcccccacgaggctcacggggccaacggggcgtcacgacacaggcgggggggaaatcaccccaaagacgcctgcaggttcccgggaaatgctctctcggggcggcaggctgcgtagacggtcattcccgctgggaccgtattaactttaaactcgcttttaaaatagttctctattttaaagatgagcatgagttctttctgttaaaagtaccgtattaaccttaaatttagcttaattttaaaatagctgtttaaaaaatatttcattaaatagttttttaatttgaacctattgcattagttctctatgtgaaaaataccatgttaaccttaaatttaattttaaaatagctattttaaaaatattttattaagtagttctttaaacatatagcattcgttctttctgttcaaaataccgtattaactttaaatttagtttaattttaaaatagctatttaaaaaatattttagtaaatagttaatttaaacatattgcattagtcctctatgttaaaaataccgcattaaccttaaatttagtttaattttaaaatagctacttaaaaaatattgtagtaaatagttctttaatttaaacataatgcattagttctctatgttaaaaataccatattaggtttaaatttaatttcattttaaaatagttctctatttaaaaaatattctattaaatagttctctgttttaaacgtatctattagttctctctgttaaaaatatggcattaactttaaatttagtttaattttcaaatagttctctattttaaaaatattgtgttaaatagtttgctgttttaaacacattgcattacttctgtatgtcaaaaataccacattaattttaaattaaagttaatctaatttgaaaatagttttttattttaaaaatattgcattaaatagttgtccattttaaacatatagcattacttctttctgttaaaaataccgtatcaactttaaatttactttaattttaaaacagctgtttaaaaatattgtattaaatcgttctctattttaaatacattgacttatttctctatgttaaaaatcccgcattaattttaaatttaatttgatttttaaaatagtcctctattttaaagattttgtatcaaatagttctctattttaaacatattgtcttcgttcgctatgttaaaaataccatattaattataaattttacttcattttattttaaaataggtctcgatttaaaaatcttatattgagtaattctgtctgtgaacctttcctgctacaatttcaccccggccgctcccatctcgacttcaacctacctgcgcccgggcccttgggcgcggtgagtggcacgcgcaggtgcgcatgcgcggggcggtgggcgccatctttgtctccagggatgcggttcccatggcaacggcgatgcgacgggaggaggatgatggacggatggacggaccacgcgggtcctcgtgcgccgtccgccacccgtcccgtccgctctcacctccttcagcgcctcagcctgatgccccccacgaggccttagggaaactgaggccaccactctgcaaacagacacgctcgccccgtcttcacgggactcttaggtttggtccctggggcctgtgaattaaacgggccaaaggtggattcacaggaggataggcacatgtttctttaggaacgtcatacttttattatcttattattttctgtgttatattgcattattttatttttagtttatgactgctttatatgttatattgtattattttatataataatatttttatttattttctatagtattttcacatcacattattttacatcataaaatacataacgctcccaccttgaaactgaggacccggttccacccggttgaaatctgcagcccagctcggcccctcggaggggtctgggccccgagcgagtccaccgcccggcccaggggtcgggagtcaacctgcccgtctgacccgcctctccgtgtccactgcagagtcaagaagctcctgatgcccagcgtccccgaccccaagttcaccttccccgggctgttcgagtctcaccgagggcacttccaggtgaggggtcaccccccagggccccctgtcgtccttcagggtcacccagatgctgtcccggggtctcaaggcagccgatctccagatgactcggggggcccgccggggattttccgggctaatcggcttctgatctcgccaggaagtcgcgctctcgacagcggcccctgcgccggttcccaaccacccggcaactcctcttg

SEQ ID NO: 98 - DNA, 19319 bp, Equus caballus
catacatgatgttatgagggggtgcaaactcaaaagccaacatggggtccccccacaccccatggccactcggctccttcgttacaccgcaggtggacccagcaagccgggccgggcgggaacagaatcctgctctccagatcctacctaccagccgtccagctcttattctgaaagggggactcagttggcaaccatggggacatttccccggaccttcagtttttcttcccgaacccaccctcctgacgtccctctgcatctaagacatatttaaattgaaaatcggtcccttgaaacatctctccatccagtgcgtgtattttttttccattgaaataaagagaaaaaagaaacagttggcaccagagctcttgtgacaattaagttggtggttggtgtccgtgtagacgcagaaaattcacaggaagctgggacacgggtgtgacgacctattcctggggccaccacagggacagaccccggaccttgtttctgggccaagacggccatttagacccataggtttggcttaaatgcattccatccatggtcgtgagtaactgagaaaaacaatgacccggccggcctggtagtgtaggggttaagtgtgcgagctccccttcagtggcctggggttcaaatcccaggtgtagacctacacaccgcacatcaagccacactgtggcagcgtcccacatgcaaaatagaggaagactggcacacgtgttagctcagggccaatcttcctcaagccaaaaaaaaaaaaaatagaaggaggaagatgggcatagatgttagctcagcaacaatcttcctcagcaaaaaaaaaaaaaaaaaaaaagaggaagatgggccatgtcatcaggactttgggggatgaggatggagagaatctgggaggggaggcgatgctgggctgtcaccaggaagacaccacagggtccttcagtcctgctgctgggtgttcatctggaggaagcgagagcttcatctcgaagagatacccgcaacccatgtttgtgtaagcttgacttacaatatccgagacgtggaaactacccaagtgcccatggatgggtgactggacagagaagaggtgggctgtccatacaatagcaggtcactcagccgtgagaaagaaggaaagactctgaggggtgcagaagaagtggtgtatctatccatacacacagtggagtattattcagccatgaaaaagaaggaaagcctcttatgaatgaagaagatgtggtatatgtatacatacacacaatggagtattattcagccgtgaaaaagaacaaaatcctgtcatcaataaagaagatgttgtctatgtatacatagacatgtatgtatatatatatatagaatagaatattattaagccatgaaaaagaaggaaagcctctcatggagaaaggagatgcagtctgtatacacaacggagtattaactgctcgtgaaaaagagaagaaatccttttatggacaaagaaggtgtgggctctacacacaatagaatattactcagccatgaaaaagaaggaaatcctcttatggataaagaagttgggtaaagaagatgtgataaatacacatatacataatggagtagtattcacccacgaaaaagaaggaaagcctcttatggataaagaagatgtggtctatagacatgatagaatattactcagccatgaaaaagaagaaaagcctcttatggataaagaagatgggtaaagaagatgtgataaatatacatatacataatggagtagtattcacccatgaaaaagaaggaaagactcttatggatacagaacacgtgatgcacacaaacactcacacacacacactggagtattattcaaccatgaaaaagaaggaaagcctcttatggataaagaagatgcagtctatatacacaatggagtattactcacccatgaaaaggggaagaaatccttttatggacaaagaaggtgtggtctatatccacacaacggaatgtcattcagccacgaaaaagaagggaatcctgccatttgcgcccacgtggacggaccctcgagggcgttatgcaaagtgagataagccaggcagagaaagacaaacaccgtgggatctacttatatgtggaacctaaaaaaaaacccccaaaaaacaaactcgcagctacagagaacagactcgtggctgccagaggccggggatgggaagtgggcaaaatgggtcaaaaaaaaaaaaaaaagaaaaaaaagcgacggaaacgtatatttgatgttgggcctttgtcctcggttcctacatagaacgtgtgatgtcccaagtgtggacgtgagaggaacgtcttccgtccttcgtactaagtcccctttgacctcacccgggtcctccaaggcccccgagtggcctcgggacgcgtgatcccatcgataggaaacagcaaaagccatttttgtccctggtgacgagaaaactgggccaaactataaatcaggtagattcaatttagaaggaagtgggtcttttccaataaaatttatactttctggggaaataaagaaacaaatggagacatagcggagaaaaaacttcctacaccctcttaagtcctgtccaccaggggtgtgcaaattaaaccgacaacagacagacgacccccagcgtcccagccccgctcctgggattcccagaatgctgtgcgacccccccgatttcataaccacggagcatctcctgctcgtgtttctagaacgtgctccacgtcccgtctacgtcatccccgaaattagtctcaacccccccaaaatgaaatgtccaattttgtccaaattttgctgccggaaactcctcacgaaacgaaaccgccccttacctgcttctgggcgtatttctgaagaaaacggccttttctgtgcgttcccggcaccgttatgaaaatcaggaaatcgagccccgataccatctgtcgtctcatccacactcgtttatgactgattctcgcccgaagcctgagatctaatctaagaggatgcatttcgcttttctcccccgtaaaccgcagtgcttttctgagtctttctgcccctggacgatttttgaagagtgtggggccgttatttgggagacctgcgtgtcggtttgggcgcgtctgacgtttttttcctggttccacccgtttgttcattcgattcgggagattaattcagagtcggattttggggtaacgtgtccttccacggtggggtcaccgtccccactttgcaattagtgagcaacttgttgggcaggacgctttggggtcatatcagcatcccggtcgtcatcgggttccacccactcattgatgctcttccagctccatctcttctgcatcaaccgttgaaattctgctcttagaaacagccttctcctcttacctacttacttattcatttatttatctaatcccgcggactcctgagcatttattttactcagccatgctgtggcaggcgtcccacacataaagtagaggcagatgggcacggaggtgagctcagggccagtcttcctcaaaacaaaaagaaagaaagaaaagacaaccacctgaggacacggggagaagacggccccctgaggaccgaggcagagaagagagggaggcggccaccagcccagggaccctggagccccggactccggaagaggcaggagggaccctcccctggagcctccggagggagcgcggccctgcgacccttcgacctcacgctcttgggctccaggacgggggaggatggaccggatcccttagattccaatccacccagttttcagggattttgtttcagccggccccggggcccctaaggccctgataaggcctgcattccagccctacacgtctggctcgctccaccaccgccccccgctcccgtttgtctgatcgtttctgcaaccccgagagtcacgaccccccgtcgccctcacgaaaccccctccttcgcttaagccccgaatccacagaaaccagtttcccaacgtgcggcgcgcggggcgttaactccagtcgctcggcgtttccgtgcgtccacaatcgaaccccgaaaaaacgcgggctcggaaacctcccggagacaaaccgggtcctcatttcaaccaaaaacccccggcggcatctggggtcacgtggtcctagccggtccccccgcgagggcacgaggcaaccagaagcaattagatttttaggaaaaaaaaaaaaaaagaaagaaaacagtttccagacgctgcccaggccccggcgaggggcctctggttaatttgcaaaaatacgtcgtaaaaacggtctgtgttttgttagcatcccccgcccgccgcgttctcacattttcttccattaaaaaaaaaaaaaatcccctaagatggacatttaaggggctcccatgagacctgtgcgctcgctcctgccaagaaaaccgccgatttaagacgtgctgagtttcgcgggtggggacgctgcaagttttaaggcaaaaaataataataataataaaataatgataataataataataattaaaaaaataaataaaaatcgctttttgcaaaatgcactggtgcgttgcacgttcccccaaaacccaggtccccgtgtgtgtgtccacactcgcaaacgcttccatttgatcccgagcccgtttcccgtttccgagagccagggggtccctcctctgttgacctcacagggcggccgagccccagaaatccccgttttcctcggctcgctgcccggattccgaatctgggtggtcgccgcccgtcaggctgcaaacggggagcgtttggggacccggtggcagccgggttggagggtttttaaatttctgcatcattggcctgctcgcctcggcccctgacacgcttttgggggcaaaaacggtcaaaaacgttcagcgtttcccgggaagactgtgctcatgtcctagcatttctggcccgtctgccgcagagttttctggatccctggaaacgtggaacctgaaccgggttcatgcacgacctcgtgctcatttcccccccggaagttataataatttccacagggtaagtaggtgttgatgctgtgtagatacttttgtttgtaaactgtatgttggggactggatcagctcgatcaagctgcataacaaagtatcaggaatgtgatgaccccggacagcgtgcaagttgtggcccaggaaaccctttctgccttcaaccccaagttcattaaatgaatctatgacccggtgaaactccatttcgacttcactagaaattcattgaatgaatctacgaccttctccacctgcaaatagggtgtcagtttccacgggtgcagatgttctttctgccctttggtaaaaacgtacaatttcttccaccaacgatttgcacgtcttctgttaagctcctccctgggtcctttattattttggggaggccccttcaaaacagagacgtccagcctccaggcctccagcaaatgggatgcctgtgtatatatatatatatggagagcgagaaaaagatgtatgatcaggcatcaactgatgccatgatggagaccagcaggccccaaatttggggggccgaccagcaggctggagacccggggagagtcgacgtggcccaaaaaagcgaccgctcggggattctttctcaccgctctttgggtttttgtcatgccttcaactgattgggcgaggcccacccacattgggaagtgcgatcccatttgcctccaaatctaccgacttcgctgtgactctcactcccaaaaagccctcccagaaatacgcggaatgacgttgtcccgagtttcccgggaccccatgagccagcagagcggacccctaaaattaactgtctctacccggttgatgtatggcgacatccgggggaccatcgccgcgtccagctcctccgggcgttgagggaacgtctggaggacggagagatggcgaggacccccagactcgcgaagccacaaagggacgaaggtccctccagcggctgaccccgccctcttgatcccgcctctgtattcgcggacaggaggacaggtccaccctgaagcctcggggtcggatcaaagccgccccctccgctcacatctcaggggtcgcacccccgtccgttcacaccaggcgcccccgccgtgaagaccccacaggagcccttgggggtcgcccagcgcgtcaaccacgtgctggtggatcaacccatctctttgctcgtctctggtccccaacccgcctccccaggcgcaggggaccctcgcgggtggcgaacatcagaagcagccaatgggaacccaggaatttctgcacgttctcaacgcggaaaaccctacaaccccgtatttgcgaactgggtttcattccgtttcctccgcgtgcgtctccatccgcgggatccgcccccaccggcgccccgttctcgcgggatccgcccccttctcccgggatctgcccccacccacgcccccttctctcagggctgcagacggtcgtggaagccgcgacaaatacaaagaagcagaaccgatcctatatttcaaaaattcacggttattttcacatggtgccgatgatacgacacctaggattttcgacgttgccttttttctttttaatattatggaaaactcctttctctgtgttttaaaaactgtccttcgtaaatgtaattttgataactgctggtgttggtcaggtttcatggttccaagaagaaagagctagtgtgaatttacaggtctctatctctatttctatctatatccatatgcatcgatcatctatctataatcgatcatctattcatcatctatctatccatccatctatccatccgtctgtccatccatctatcatatctgtcatccatctatctgtgtatctaacatctgtctgtcctactatgtgtattatgtgtgatgtgtgcctatgttatcaatcgatcgatcagtcatctatctatccatccatctgggctcccgtcacagccgctggcccaccctgtccacacgtccgtcctcacctctcaccgtgctggcctcctcgctggccgccccgtcagggtggcctccccgtcctccccagcactccaggtccctccgcccgccctgccccttccctggacagacctgctgccccgatccccgctgtccacgcccagaggagctgctaggggccagccctggaccacggctgggctgggcactgtgattggctggcccgggtcacatgaccttccaggcccactgctgtgattggctggcctgggtcccatgaccccctctgcatcccagaggagctgctcagggccagccctggaccatggctgggccggatgctctgattggccagcccaggtcacatgacctgccaggccaggcactgtgattggctggcccaggtcacatgacctgccagaccaggtgctgtgattggctggcccaggtcacatgacctgtcaggctgggcgctgtgattggctggcccaggtcctatgacctgctctgcatcccaaaggatgctgtgcggatgcagggcctgctggaccacgacagggccaggccctgtgattggccggcccaggtcacatgacctgccagaccaggtgctgtgattggctggcccaggtcacatgacctgccaggctgggtgctgcgattggctggcccaggtcacatgaccagttccacatcccagaggagctgcttggggccagccctggaccacggctgggtccgggccctgtgattggccggcccaggtcacatgacccactctgcatcccagaggagctgctcggggccagccctggaccacggctgggctgggcactgtgattggctggcccgggtcacatgaccttccaggcccactgctgtgattggctggcctgggtcccatgaccccctctgcatcccagaggagctgctcagggccagccctggaccatggctgggccggatgctctgattggccagcccaggtcacatgacctgccaggccaggcactgtgattggctggcccaggtcacatgacctgccagaccaggtgctgtgattggctggcccaggtcacatgacctgtcaggctgggcgctgtgattggctggcccaggtcctatgacctgctctgcatcccaaaggatgctgtgcggatgcagggcctgctggaccacgacagggccaggccctgtgattggccggcccaggtcacatgacctgccagaccaggtgctgtgattggctggcccaggtcacatgacctgccaggctgggtgctgcgattggctggcccaggtcacatgaccagttccacatcccagaggagctgcttggggccagccctggaccacggctgggtccgggccctgtgattggccggcccaggtcacatgacctgccaggccgggtgctctgattggctggcccgtctcccatgacccgctctgcaccccagaggatgccgtgcggatgcagggcctcctggccctctgacggggcagagggggcgcccacctcacagacgccccctcgtgtgtctcaatgactgagctcggggccgcccaagggggctccacggaaacgaccagaaaacggggtgagacggccgcctccaacaacctgcgtagacattacgtacttgaatccccttctccaggcccaaaggcaaagcagcctcgaaaggctctgggtttccctttggcctcccagccccgcgtgtggaccctcgtgccccgcgctgagcgttccctgtgaaaaaatgacccaaaaagggaaaaacggcatttccatgaggattcattttttgtctttcttgggccaggctgcgcaggtttacttttcaaatatttattctccgcttctcatttttttcccccttttttcatattccagccacttcgttaggcacggaacagtccttgcatctccgctaaccgctttgggtgatttattttgctatttccatttattcaataaattatacgtttattaaatccttttgcttatttactccactatttctatttattaaaggcttattttgctctttgtgggtattaaatagattagataaggattaacttttcattacgcaccgacgaattcttgccaaggcctctcccatggtggttttgggttatttattttgctattttgatacattcaatggaacttatatatttgttaagctaaatattgtatttattaaattattctatttgttcgataggaaccaggcctcccggggctcctccagctggagattcaaggaaagccaatcaccttctgggcttaacttgactttggggaaatgggaatggaagaggcgtcatgaggacgacggggaggaacagcgagcgtttgacggggtttttaggggttgtgatgcatttgtagggtccccccaatgttcacgtccccccaggacctcagaatggggccttatttagaattgtggtctttgcaggtgtgatgaagggaaggatgcagaggagcgcttcctggaggaggcggccctgaatcaaggatggagaggagggcttcctggaggaggcggccctgaatcaaggatggacaggagggcttcctggaggaggcggccctgaatccaaggacagcgtcctcctcagagacggaagacgagacgcagacgcagaggagcagccccgtgaggacggaggcagagacgggagggaggcggccaccagcccagggaccctggagccccggacactggaagaggcaggagggaccctcccctggagcctccggagggagcgtggccctgcgacccttgaccccagactctgggctccaggacggggggaggatggacccctcgggttcaaactaccaagtttgcaggattttgttccagccgcccagggaccctagggccctgataaggcctgcattccagccccacatgtcccgctcactctgccaccctgcaacccttcaccccagacttctgggctccaggacgttgagagcatgaatttctgtggttttaggcccctttggggtccttcgtttcggccgccccaggaaaccgagacaaggggcagcgctggaaaatctcgcaggatgttctcaacagcgacgatctcttcggagccccgtaatcgctgtcctctcgcagccgcaggaaaacaaccgcccgccccggggcccccacccagcgtgcttctctgatgtgggaccccggctttcaagggcagccgggggtcccgggggagaggctggaggaggagcagccacagctcacggggacgtcaagctggcctcacttcggggctggtgcagaaacagcctccacgtccatacgcagaactcagctcgggcatgacggccaccgtatttgggacattgccccagaatctggcctcattgaggactggacggctgccacattctccgcctccaagtggctcttaagagaaatccgtaggtcatgatagttctagactgaggtctgcatggtcgaagacaaaaaaaaaatttcctctacccttttaagttctgttcgtgaggcctgtcaattaaatcgacaaaagaccaattaacaagagaaaaaagaaagagttggtttatgcatgcaacgcgcatacatacaaaaccattcagtgacgagtgtagagagaaaaaccagtgtcctctgctcacctttggttctctgggtgggggcccgtgaataaaattgtccaaaggcagattaaaaaggaaaaaaaccccagaaatttaatagaaaagatatttagggcttctgggccggggccgcaagtgatgggaaggtgacctgggaattatggcgaatcaggctgtttaatagggtttgctacgcagactcgagtcggccctggtcccctcgtgagtcactgacgggcggttagaatttggggcttctcctacgtctcctctgggcgaggacgcttacaggaaaagctgcgatcttttggagagataagcgggtttttcgagaacaaacaagagataagaaaggcggcgctgatttctgtctatacagagatgagtggtctttccaactccttcggggccataaacggcccctggagaaaggccccgggggaggttttttgggttttccagccctgggagcgggtccaccccgaagacggatttatggggcctggtttcccacaagctcctgctttgggtccgatgagcgaagctcagagaagccctgtttccagcctctgctgcacagcaaacgtctacacctcagaatcatcttcggggtttcgagcgggtcctcacggcgggcagacagagaaagcaggcaaaaggcgtgttggaccgtctctgttctttgtggggccggcctgacacgcttggggtttctttaaaaaagaaaaagaaaaaagaaagaaaccaacctttctgtggacccccgttttctcctctgcaggaagcagggttcactgagtgactaactgttggccctgacgaggcacgaggtgggggccagcttcctgcattgagtgagggccactggggggcctggaggggacacgggatcccaataaggtcccaccgggcgggactccatctgtcctggttttccccgtttttggtactttttcctccttgtatacgaaaatctcccttttctccagatttaccgtctacactgaggtttgtcacctgcccggggatccttccgtgtgcggcagggagtgaggacgcggccttcattccagggctgggcgaccccgtgcgtctccagcagcccactcctgccatataatgtccctactgaccagtcgggcatcgactgtctgatagaccgtatttttttcccatttccttttttttttttttggtgaggaagattggccgtgagctaacatctgttgcccgtgtgtgtgtctcatatcagggtttatttagaattatcctgaaccgccaacggctttgtctgatgtgggattcgggactcacctccccctcagatgccacagatcccaccctcggccccccggccacacttcgctgcccccgggttggcctccttccatggaacggctccctccgaccttacagacgtccagtttcccagaattcccacctatcccttaaggcccaactcacgtgagcccaactcacacaggcttgagttagactccctcagggggatccgtgggtttacggacacagctctcctcggcccggaccaattcaccaacgtcatctgacaagtttggcgtcaagatcgaaggctctggggtcatcccgggtcagaggtcagggccacgtggattctcagcccgggagtcccctcctgcactgctgcccacccccagcatcccgtgggcctttgctaactacacgccagggggcccagtctcgtggctcccatctcgggggcacaaggagggtgactccaagaaagctcaaatcttggctttcgtctgcatctggggaggccaaaatttgaggaagaaagagggaaaaacaagaacaaagatcaacatagggtgggggacgcctttccctctattcacagttattcatactgttatcaataccattcctacctaggaaccacttttctacactgtcaagttctgttctcggggtgtgcaaattaaactgacaaactcttcacaagagaataaaacaggtttaattacgcacgtccgcatgggagtttacagagaactgtgactccaggaggcagatggaattttgggcttatttaccatataaggagatacgtttgtgcaacaaattctttctgggtgtcgtgctgaggccccctctccgagcagagatcagagatgctacgagggaccgtgtttatgacatcgagttctttgggggagatcaggaatttcaggaacctaagtgccttcggctcccaatattttttaggccacagcggctgcttctggatcccttcagtgtcaatatggtaatagtgcatttttgtcaatcaattcacctgcaaaccagggccctggaaagaggctctgggacattctcaccctcgtccacacacccaccctccccgggaagcgacgtgtcccccaaaaaacgggacaggctcaccccgttgcccacaggctgccccccatccgagggccatcctctctccccatccggggcatggggagaagaaaaaagagagtagagtttgaacccgttctccgtgtgtcagagttgacgtaaagccttggcctgtctggtggtttacaatttatttctagaaaagattccctcatccgagaaaggggaggtctgagctggccctctcccaccggcagttatttaggcaaaaacgtgtataaaaaagattaggcctcgtcgttcgactgtgtatttccacctaagtgcgtcgggcgcgatattttgcattttactctatttctacccaaatgcgtaagattacgtagattttgttctgctgttcattgcacccgaagtgcatatagttaaatatatttaattgtaccatttctttctaggtaactgtgcagaattagatacattgtatcctcctagtcctttctactcgagtgtgtcacattggatacattgtatcctcccattgtttctaccacaaaattagatactttttatcccacgcttcatttgtatctaagtgtgtagcgttaaatatatttaattctaccatttatttctatccaattgcattaaattagatacattgtatcctactagtcatttctacctgagtgtgtgacattgaatacattgtatccttctagtcatttctatcataaaattagatactttttatcccacgcttcatttgtatctaagcgcgtagcgttaaatatatttaattctaccatttatttttatccaattgcattaaattagatacattgtatccttctagtcctttctacctgagtgtgtcgcattggatacattgtatcttctcattcatttctattataaaattagatactttttaacccacttttcattggtactaagtgcacaaggttagatatatttaattctaccatttatttctatccaattgcattaaattagatacattgtatccttctagtcctttctacctgagtgtgtcgcattggatacattgtatccttccggtcatttctatcgtaaaattagatactttgtatcccactcttcatttgtgcctagggttagatacatctaattgtcccatttatttgtatctaacggctggggttggacacgttgtatcctactagtcgtttccactcgagtacgtaagaccggatacattgtatcctctcctttgtctccaccgcaaagttagagacattttaacgcgctccgtttccacctccctgcaagggttccgctgcattttcctgactgtccatttgtgcagttacacagggaatggcgtcgatcgttctaaaaaaaacgtctacccggaaacgtcgctggcaaagtcaggattaggccgtttctgcaaggacagcgcggcccctgaaagtcggcgtcctggacgcagaattaacggacggaggaacgctggacgctccgttttgacggctgagctcggaccacacagcccggaaagcagttctgtctgtcccctctgctctgtccgtccggactcggtcgggggagcgggtccactttctccctgcatcccgtctacacccggttcccgagttcatgaaaacgctccgtttgatccgtccgaagtcctgcatttccaagaaacgcgtttgcctctcctgcagcagccccacggcctggaaaacgggtgcccaaaaatagggggaaaaaaatgatcttctaacggcagagtccacgctaccaatattttcactgcctcggctgctctgctctgtgcaaaaccaaaataaaccgattcacaaacaccacggcccgtccgggcacagacacactctgattttcttttttttttttcctccactcccgtctccaggtgtgagtccgacctccccttttctctatttaacacaagactttcttataaaaacggccaacgttttttctgcccgtggaaaacggccagcgtggcaagtcccattcaccacggccccgtcggtaacgctgtaaacggccttccgagccggagtgggtgggggggctccggcggcccgtccgtctacacagctgtcactcaactctcaccggcctcccagcaacgtgcagctcccagagcctaaccagacgcccggagtccgcgtctgaagaaaggagggaaggaaaacgcccaccgttttcacagcccgagaaggaagaaatacaacctgcgaacgtccccctgacggataaaatacggttctcgctttttaaagccaaacagcctttcctggaaggagcgtgtgcaaaacccaaccaccgcttaacggtctcgcaacctgcacgcttaacggtgtttctcgagactcgattcgtttaaacagcaaacacattccgtgcgtttggactctgcaccccccgggctcggaggatcgaggcctgcgttgcaacgcggaccccgaagaagcacggtgtctgcggggcgggggttcgggggcgccccacgtccggccctaaatccccctcgtgtctggttgcagaacaaacacaaggcacctcgcaaaacgctcccccgaaaagacgagaaaacccggaccgatgtctcagtgacgcttgaaaaacgagtcgcgtccaatgcagctctgagtccaacgccacacgcttcctggcaatccgagtttcaacacggagatagcgtcctccgtcgctttgatttccccggcacctgggtctcaatttttcccactcggcgcatcgtaccagccctcggatcccgcaccagccaaatgcatcccggtttaccatgcaccgttcaccatgttgcagactgtgccactggattggctgcaatttgtcccaagttactggccggatctgggacggcaatgaccttgacgaggacccacagaaaggcccgagtcctcccctctttacctcccacccagaaagctccgcgttaaaattctacaaaatacgctcagtcagtcagtcaacaacgtttccccggaggcgaagacggggagggaaccccaggacttgctttgtgtttgtttgtcgggcacccggtctggatggagccttttcgacacgctttcactttctccctccacaaaccggcttgagatccgagtttccgctcagcccgcacactcggccgccactgggtggcagcaggtccccgcggctcctggaaacggggacagaaaggaagaaaaaggtgagtccagccgagtgccccgtttgttccgcaggcctcggacccccaaacccgacgacgaccggggtgggggggggcccagcatccttaattcaccccaaacgcattcccgtctctcttcgtgataatagactgacttttgcagccgctaacggccccgggggacacccgggaccccagagggcggcccgtacccgagtgcagcccggcccaccctgccgtgccccgtgcccgtggcccctcgtaaaaaaaaaaaataattcccccaattcgcgtaaaacgaagtgtgtccttttccttctgcctccatccttcaagacccccttgttgttttcgtttggaaaaaaaaaaaaaaaaccgaatggcacaattaagggttgttgagcccgaataaccgaggggggagttgcacattttatggccccggttctgaaattcagaaatgccagaattcagccaaatccagctgaaactcattaagggcccccactccatcgctcagatttatgattatataatttcctaaggcccccccccccaacgattcccactgaaaatggggcccgttttctcccagtgggttccaggcccttcgtggtggagggtttggtacaaacgacgcgttggcgttttttccgcaacgcccaccgtttctcctccagccccgagcccgttggtttctgaaagttgctttttttttttttctgggcattttttttttttttcacaaaaatctccgagtcccaggggcgggcgccacctgaccccgaggccgggaccctttttttctggagatcccggggctttgggaaaactcgaaacagaaccagtgaaattcgcaaagacccgccaagatttttccctcgaaaccgcgattaaccggaggcctccggccctaagtcccgaaaacgctacattctcacgggaaataggatggtttctattatccttaagtaagattttattacatcccgaaggcagcgcttattccggggcggctccgtttacggcgagagacggggacgaggagattcaaccgcgaaggaaggaatgtgatgaatttctgcgcacaacattctttttattattgccgggaacacatagcgcataaaatttaccatcttggtcgtttttttttttctttttttttttgcggaggaagattagccctgagctaacatctgctgccaatcctcctctttttttttttttttttttttttttgctgaggaagactggctctgaccagagcatggcactgggctgaacttcatgatcgcttttaagtgcgtggttccggggcgtgaagcacattcaccccgatccgtctccggatcgtgttcattttccccaattgaaactgttgaccataaaataatttttaaaaatttttaattttttaaaattattttaaatgtcttgcaggcccggcaccggcacccgccccgcctcctcctcgaggccacagtggcccttttcggggcccctcccgccgcccatcctccctccagcagccgccggacaagcccccactgttgcagccccccatcccccacccccaacgcctgcagcccgacccgccaggcccggccttttgcacacggcccggcctcataattaacgacccgaacgctgaggggagaaacccaggcaccaagagtttattgtttggggggaagaaaataaatgcgcgcttagctttttttttttcttcttttttttaacgttaaaaaaaaaagtgagtttgcaggctattcgtgaaatgcaagttttttctcacgaggccccggtgggaccggatttggacgcgagtggacgcggtgggggggggggatctgggtcatccgtgaagccgggagggcgccctgggcgtggggaccgttttcccagatgcggatggggaaactgaggcagacccggtgccgccgtggtgggcaggccgacgccctgtggtgcttttttcctgcgaaaagcccgaatttggagtcagaaggcgggaggaggacccgggtgtcggcctcacggggcgcggggaaggcggcagggtggcccctggaaggagggagggcggccctgtgacccttgacctcagactctgggctccaggatgggggaggacggaaccctggggtttcagccccaggtttggggttgttcactggggccgccccaggacccttgcacacttgaaatggtcgagacggtcgagttcatattattgtgtcttttaccacgattttgacgaaaagtactgccatcgaaaaaattgagtttatttaaaaaacataccagaatgtacccgtcacaggagggggtttggtcctcagaccccgtttcgccgtcgaatgtcgtcatatttcatgcacagagggactgacaggcctcggcgatcaaggccgtcctccacacgggtcattttgaggactcgtctcacgaattcacggggacgcgggtcttcgccacgaaaaaagatggtgtccagtatccagatgtctaaaacactgccgttttgcctggttttccgggtaattcagcaggtagggggcccccatcctgcagagcacggcttcccctggaggcatgtcggcctccgtgtgcacagaagtgacactacccttcccagaaagcttctgcagcttcttcttctgttctttttttttttttcctgaggaagattagccttgagctaacatctgctgccaatcctcttttttttttttttttttgctgaggaagattagtcctgagctaacatccgtgctcatcttcccctacttcatatgtgggacacctaccacagcatgacgtgccaagcggtgccatgtccgcacccgggatccgaacccgcgaatcccgggtcgcagaagcggaagtgtgcacttaaccgctgcaccaccaggccggcccctgcggcttctcttcgaacccagacctgggggaaagcagagggaaaaaaaaaaaaaaaacggagaacaagaagacgaggaaaacgtcaaacgg

SEQ ID NO: 99 - DNA, 4380 bp, Equus caballus
gggactccagaaatcgcggcgggtccatcccgcccccgcggacttccaggttagctacctccgtcaagtccggaaccccgcaaggtcccgccgtgcccggcaacgctctgcgtgcgttccgttaagggcggcgccatggatcccgcggaagggagacggggaccgtttccggctaccagatgcctcgcaagcaacaaagcggggtggggccgggatgttttatgggcccaggctggtttcacgagagagacgcggggtcgccaccctcccccgccccctatccaaaactccggcgggctttgtttagtcattcgacaaacgggtgtcgccgtgtcccgatcagttgtggggcggtttggcgggaacggaccagagaccctgtccccataaataagccacgtgtggggtgtgttagaaatgaaggaagcgggtttgggggcgctggagccgtttccgtgttaaataaggaggagggcccgccctggtggtgcagcggggggggggggggcaggggttcgccaggtcggatcccgggtgtggatatggcaccacttggcacaccatgctgtggtaggcatcccacatataaagtagaggaagatgggcacggatttgcgctcagggccagtcttcctcagcaaaaaaaaaaaaaaaagaatagcgttggcagcagatgttagctcatggcaatcttcctcaaaaaaaaaataaaataaaaataaggagaaggagtgattggcatgtggctggaggcctgggaaagaatattccggaagcctgagcagctgtggtcagacaggagggaggagaacagaaagggagcagaattcggggagaccagggaccccacaggacaggaacagggatccgtggctggcgggacggggccacgcaaaggggaccccctctttgctggagggaggaacagagactcagggaggcggcgggtcgggagggcgaccccaaggagctgggctccccggggaaaatcccagcttgtttctgtgctggtgggaaggacccagttgagagcagagatggtggggacggggtgcggggcgggggtcgcggtgtgcgtcaccccacctgggccgccgggtggccaggggctcggtcagacaagtatctgaatcggcaggacagagtaaagcagagggatgtccccctaccccagtgtgggtgggccacgtctaatcagttgacggctgaatagaaccaaaaggggcggaaggagggagaagtttccgggctctctgtgcccgacgggcttggagctggggcgtcggtttgtgcccgccgtttggaccaaccttcccactttgggtgggggggtgtggacggggggacgtgatgtgcaggaagcagaggaaaaggccccaggtgtcgccctactgtgtgggagccggcgaaccagggaggggaacggcagctcgtgcaaacgctgcagctgagtcaagccgtgcctgattcccacctggacatccggctccctcacgtctggctctccggggccggaattgggtttttcggagctggaccaaaaaacacgcacgcccgggcgtctttgtcgcctatttcgggaggggcctccaccctggtcctgggacctggacctccgcacccctcagttggggttttatgaccaggcggccgatggctggggcaagacccacgtgggccccgcctcgtcccttccagagcttttccaactgcaaacaaaaggcgagacatcaaagggacgggccggccgccgcctcctggaatccggtttcatcctccgagctgaggatccccacatcccgcttcatggcccggggtctcggagggcgatcccgcacggaggacacgcggataatcgtccccctgaaccttcaaagggaatcccagatgccaagggcttgcaggtaaaacacggctttaatgcgtaatgctgtgggttttccaggctcgcgaccggtggtgttcctgcctgtgtgagcttccgggggaccaaaggcgtggacttgtataaattacgataaatgaaaatcaaggatgagcaggcaattcacttattttcgttggatctcgttcagtttgtccaacaaaatgagcaggcgggagggataaatatttaaatattataggaaaggggacgggatcaaggattttttaaatcaaagtcatataaacaggaaggctcagagtggtgtctggattgcacagcactgggcacaaattattgatcctaaaaacaggatctgggcccacgtcccctcctcatctcagatgcaggcccaccacctccacctccaccaggcagccctcctggaggaccagacacaggacctgggcccacgtccccccctcatctcagatgcaggcccaccgcctccaccaggcagccctcctggaggaccccaaggtgatgccatcttctctctgtctgcttccaacccaatttaacacaatgggccacagcgtggtgggccgtgtagaccaacccacagtcacagccctgaacacgcccttggcattggagctgcacacccggcgtccgttccacggccccaccggtcacctcctctgtttcctcgggggcacgacctccggaagcgtttccactccgagtgatccgaacccataagacaaaaggaaattgaaccctcaccgcccgccccccaacccggaacatgaactcgagtgaaactcctaaaaacgacctcgatcagagatgagggtttttctttccagggcgtcttgtgtctgggtggaaaggcctcctctgcatccacggagtcggggggacttggggggggtcaagatccccgtactccacaaatccggcgccccggcagccccagaatgaccctcgcttgcttgcttgcgggccttcttggacaccctgctgattgggcctcgtcccgtcccccgggagggcccgagtggggtccaggaggggacggggtgggggggccacctggcgctgtacctgccgctctcgcgggtctggacctctccccatggcgggtcatagcgtgtggctttgaacacgcgtgtgagcgcgtgtgcacgcacacaataagtcctgcgtcctgccgacgtcagcggaggatgatgggcgggtggtggaggacggaggtggagctggaggagggatgaggggaaggaggtgaaagcgtggaaccttctggaaactccctccggctctggggttttgggtgcaaaagcagggaagtggcgaaaccctgcagggtcggtgaaatcaccatcacggtgtagacgggagaccccccccccgcaccccaggcccaggtggcggctccgaatgacgaccaggggccgaaatttggatgaggacggggatccgagcgtctggggtcgtagggtcgagacagaggggcagcacgggcactcggaacggggtcttggggtgctcagcttttttttttcttttttcgaggcgaaaagtggcacaggaactcgagaagatgctccaagttcgtgtcgatggccggacgctcatgtcgtgacgatgaggatgaggatgaaaatctttgcacctccaacaccaatcccgtcgattaatcctatttctcctctttctgctccctgtgagcaaaacccataattttcctccgtctccgtcctctgggtctgtcaacgccccgtcgtagggtccacgcgtccttcatttgacaccaaaagcatccacagggcacttcccgtggatccattttaggtaaaaaaaaaaaaaaaaacccaaaacacccctcgtttgcccctcttagaaaaacccctttttctaaacaacctcatgcaaacaaggaggaaagaaagaagccggactgaaggccaaaaaaaaaaaaagaaaaaaaaatctcgcagccgacgcagcgaccgcagcgaaaggaagtcataaaagccaactcataaaccaggcgtccttttatcaaggcctccgacgaaacccgagaagaaaaatgttattaggcaaaaaaaaaaaaaaaaagaaaaagaaaaagaaaaaattgaaaaatcagaccagatgctgtctttcctccgaagccggagacgacaaaaaaaaaaaaaaaaaaaaaaaaaaaaaaagcgagatccaaaaaagaggggaaaaaaaaaaaaaagtcgagacgcttcaagaagacagtttgaggaggagaaatgtggatttttatgacctaatatccatttgaagaggagaaacggtgactgttcccatcatcggacggcgcggcccggccccgttttcagacaaatcttttttgcacacgtcccgccggggctcgtccccgcccccatctggaaccaagatagtcggcttcctcttcgcgagttgtgcaagaaatatattaatagggtcgtctctggaaaaggggccat

SEQ ID NO: 100 - DNA, 2188 bp, Equus caballus
caagatacccaggatgcctctggggaaactgtggacccaggtaaagaccccaagtcgagggggtcccttcaacgagctcccttagccaaaaggcattgcaaccagtgacaagcggggggtggggtcagctgtagggtgacccgaggaggtgggtttgcggggtccacttggtgggggtcagccgtggggtcaccctgggaggttgcatccacctggtcctcccggtcgagatcggtcctggggtccccctggtagactgtacactgacgggggttcagaaaacggactccccaggccttcagggccctcttgcctcttccggcgtccggggctccagggtccctgggctggtggccgcctccctcccgtctctgcctccatcctcacggggctgctcctctgcgtctgcgtctcctcttctgtctctgaggaggacgctgtccttgcattcagggccacctcctccaggaagccctcctctccatccttggattcagggccgcctcctccaggaagccctcctctccatccttgattcagggccacctcctccaggaagccctcctctccatccttgattcagggccgcctcctccaggaagccctcctctccatccttggattcagggccgcctcctccaggaagccctcctctccatccttgattcagggccacctcctccaggaagcgctcctctccatccatgattcagggccgcctcctccaggaagccctcctctccatccttcccttcatcacacctgcaaagaccctgctttgaaacaaggtcccattcacaaagtcctctttggcggcctggagttctgatcccgggtgtgaagttagccctgttcctcaagccacgctgaggcagcgtcccacacagcacaaccaggacctacaactagaacatacaactacgccctgtgggacttgggggagaagaagagaaaaaaaaaaaaagagagaaagattggcaacagatgtttgctcagggccaatcttcctcagaaaaaaaaacaacaacaacaaagcatgcacattggcatttgcaagcatcccagtttaacgcaagcaggaaaaacaagttctgtcttcacagcggaccttcgacctcctcgcattgcaaagaccccttgctggtcaccccaaaacgtctcacacatgggacccttctcattctgcccccacccagagctcagttttaattcaaattagaccccaaagcgtgtgcaaatgttggaaactcatcctctgacgctattgggggggtggggggtcccgcgagggccgcgtgctgaggagcgaaccccacagtctggaggtcacaggtgggctcccggtggccccaggaccctacaggtggcacgcaatcgcttcccgctccgacctcgtgcatctcgggatggggggcgggagccacctccttccctaccccccccgacccccaagtccagctccgcgcgcgaaccgggttgggacccgctcgtgaccgcgggccggcgtgtcctgtccctgctccgtctccaccacaccccccacccccgccccgactcctggtctttaatcccggactccgtgaggggtgtggggagttgggggggaggggggagcctcaaattgaaatatcccgaacagatgtaaaaacacatgtgaggccccgcgcgcaagctgtgcgtgtcttttgtttcatctgcggaggacgggcgcctgcaggagagctttttaaaatttcatccctattcaaaaggataattaatccgtacccgcaggctttgattatgctgcgctcggtgagtcaggcggcggcacagataatgaggccggcgggaggcggggcgggtggcggcctcgtgcgagtgcgcatgcgcggggggcgggggtgcgcgcgcaccgggctcccgcctctgcagaagaaatcggagccgccgccaccgccgccgcctcctccgcctccgcgtaggtggcttaatctccttttcatttggaacaccaccagccaccgacgaacccgtttcgtttgcaaccggcgcgggcctttggttgacaagaatacccccgccccctcggccccacgccccgcgtcggcgtttggcagatggcgttgcaaacgcctcctcgatgcacttttcggagccgacatgcaaccgctccaccttcgctgtgccgcaatggagggaaaaccaa

SEQ ID NO: 101 - DNA, 3598 bp, Equus caballus
actcttaatatggaggggggtcccagcacccgttttctgtaatggggcacagaggcctggagacgccggctccccatcccaggaccccctggtccaaacagtgtctccatccttggctcctggccgggggtgtgcgatgctccgagctgtgtgtcctttaagctcgagccatgacctcctgacccccaggagctcagaacgggttccgttttggaaacggggtcattgcaggtgtcgctagtgaagacgaggtcgccttggaatgagggggggccctcctgcgacatgactggcgggcgtgcttatcaaaaaaggatatttgggctcagagacgtgcacggggagagcggcatgcacagcgagggaccgacccgaggcccgaagccgagtccaggctcctcccgagggacggcctggtggtcggcgtccccatcgagggagacaaacagcgaaaagacagcccctcgtgctgggactccctccctttcagccacagctccccgaggtttccggcccgaggccttgaacgccgcgcacagcgagtgtctccatctccaggagcaggtggtccgtcccaggtcctccttccgggcgggcgcgtccctgggctgtggggtcgtctgcgttttccttacggcttcgtgggggtccctcgtctggtccacgcgggaggcccatgtctacaagcgcgtctcatccgggtccataggtgcctgtcgatggaccagctaatctattgatctgtatctccatctatatccgtatctatatctatatatccatatcgatggaccagctaatctattgattggtatctatatctatatccacatgtatatctatatatccatatcgatgggccaggtaatctattgatcggtatctgtatctacatccatatctatatatccatatcgatgggccagctaatctattgatcagtatctctatctatatccatatctctatatatccatattgatggatcagacaatctattgatcggtatctatatctatatccatatctatatctatatatccatatcgatggaccagccaatctattgatcggtatctgtatctatatccatatctatatctatatatccatatcgatggaccaggtaatctattaatctgtatctacatctatatccatatcaatggatcagctaatctattaagctgtatctctgactatatgcatatgtccatattgatgtaccagctaatctattaatctgtatctatatatgtccatatctatgtattagctaatccattactctgtatccatatctatatatccacatctatacatctatatcgatatatcatcgaatctattaacctatattaatgccatatttatatctacagccgtatcatatctatatctatacctatatctatatttatatgtatatatatctgtgaccctctgtctatatctgtatctatacgtctgtccatatctatgtccatatccatctctatctccatctctgtctgtaactatatccactcctatatcccatgtatgtggacaactgtgtctatatccctatcgagagacatgcagagacattgagagacacgcacagagatggagagagtcggcccgagatgcacagcggtctccctttccagctgggctcgggtcccgcgtgcctgtcaatcacctgcgcgtctgtcaatcacttgcgctcggcccctgacgccgggtggagccgcgcgcgcgcgcggtgcacgccggtccgcctcttccagccgccccccgtgattgcactgcgtcccgggggcctggactcgcccccacgtcctctgggcccgcgggaccgggtcagtgagggaccccgggtcccgccatcatggctgggctgcaccccaggagacggccagcgtcccaaacgcccggctgcccggagtgcgggggcctctgggaaaatcctcagcgcatcctcaccttggaatcagcctcctgcccgctggaccctccgtgatggacaggccttcctcggcggagtgacctctgacccgacggagccgacccgtttcctgtctacacgtccggacggcgcgtccccccgaccctaaaacccggggccctcaaacgcaccccgtgcctgaaccccgacccctgccagggccccacggccggactcggggacgcccaccgtttccgccccccgccgccagcccgcccgagcccgcaggaccgcggcgtctacgcaacaagccacggcggggagaggtttaaatccgtgctaatgctgatgaccaattaccgtcgtcaattagggggaaacgctcataatgaagagaatccacttaatttcaagccaggcctaaggcctgcagggttgttttttttttttcttcaccctcgtttcttagacttttcattagggaaaaagagaaaaaaaaaagttaatgggtgtaatccatgcgggtagtttgtgggcagaaacaagtaatttaggtcctgggaggccaaacggactattgttattttgacagcctgctaatttcaggccctgcaattagccggtgccagcggttaattgcagaaacgcggttaatattacgggggttcgtatgtgtgatccgaggcggtttctctgggtcgtgtggggagcactcacggtcggggccccggtgaacgccgtgccctcctgggcgtgtccgcgagtccggggtcagctcacccgggtccagccgggtccagccctgtgtgtagactggactggaaggatctgtgccagcagcagcgtggcccagcctggcgactaccaccggtcctgctccgtccacactggcccaggggagcaccatgaccctggacctgctccgtccacactggcccaggtgagagtcatgaccctggacctgctccgtccacactggcccaggtgaactccatgaccctggacctgctccgtccacactggcccaggtgaactccatgaccctggacctgctccgtccacactggcccaggggagcaccatgaccctggacctgctccgtccacactggcccaggtgagagtcatgaccctggacctgctccgtccacactggcccaggtgaactccatgaccctggacctgctccgtccacactggcccaggtgaactccatgaccctggacctgctccgtccacactggcccaggtgaactccatgaccctggacctgctccgttcacactggcccaggggagcaccatgaccctggaccctgctccgtccacactggcccaggtgaactccatgaccctggacctgctccgtccacactggcccaggtgagagtcatgaccctggacctgccccgtccacactggcccaggggagcaccatgaccctggacctgcccggtccacactggcccaggtgaactccatgactctggacctgctccgtccacactggcccaggtgagagtcatgaccctggacctgctccgtccacactggcccaggggagcaccatgaccctggacctgcccggtccacactggcccaggtgaactccatgaccctggacctgctccgtccacactggcccaggtgaactccatgagcctggacct

SEQ ID NO: 102 - DNA, 7130 bp, Equus caballus
aatcctcgtttgtccaaggtgacagaaagccacccggggcacattccgattccaccattgcccagaggtagcgaccatcacgaaaggaccagtccggttccaaccctgcaccgaggtgaactcctaatcacctcgtcctagctcagtccacaataggccatggtgatctccttgaccctgggcgctgctccagtccacactggcccaggtgaactccatgaccctgtgacctgctccgtccacactggcccaggtgagagtcatgaccctggacctgccccgtccacactggcccaggggagcaccatgaccctggacctgcccggtccacactggcccaggtgaactccatgaccctggacctgctccgtccacactggcccaggtgaactccatgaccctggacctgctccgtccacactggcccaggtgagcaccatgaccctggaccctgctccgtccacactggcccaggtgaccaccatgaccgtgggccccccctccaagcgatgcagacgctcggggtgggggcgcccccagacctaggcgttgcaatctgcattttagcccgacccccagtgcgtttgagaagcggcgatttcatagtcacacttcactgcgacgatcataaagtcaatcaaggaacccttggctggcgtcctttgggcgctcatgggctcattcgagcgcgtgcatgggatttttggtggtgaaagactgagtcaggatccggggcaactcagggggtccccctgcagcgtcccccccccgccccgtccgtcgtccttggggccaggctggcgtccccgccttgaggaacttaaggcttctctccccaccaggccgacggggaacggggtccaagccgccccgtctcccagcaactcgcttctcattcggagcccgggactcagtgtctccgagaaggaagaaaattgttggccgctggaatggaaacccgggacccccaggtccacactcgccccaccgcccgccacgctgagtcctacccgaccgaccccagggcccgggagccaagagccgccagggggcctccgctcctggcctctcgcctgaccccggacagctgacccctccccggtcccccaccttcgacccctgtgcagaccttatcaggacctttgtcctgccctccggctgattctgagcacggcccccagccctggcctcggggaatcctcgggccccgtggagcccggagcgagttccctgcccctctgacccctcccatctcccgccagaaccgggtctccagcctcgggcggccgtcttgtccccgcgaggccctgtggtcctccggtcagcacccgacgtccgcttctggagaccggagcccacccagggctgtttgcaaagggcgccgggccgggggtcagatctgcagacgagaacagacagggtgagaccatcctgctgcccggggcagggctgctgcgtggggggcgtctgcctcgaccccccgccatccctccgctgtgtctgtctgctctctacgacccccgtggatgatgcacgtgtaataatatatacagcaaacacatcacactctgtctacacatctaaacacctaagtgcatgcaaatttatgtaaatgcatgcagaaatgtgtgcacactatagacgtgtgtctgcaaatttataccctatatatgagcatataaatacgtgtgtctgtcaatttatatcccatatgtgagcatataagtctgtgtgtctgtaaatttataccctatatatgaatacgtgtctctaaatttatatcccatatatgagcatataaatacatgtgtctgtcaatttatatcccatatatgagcatataaatatgtctctaaatttatatcccatatatgagcatataagtctgtgtgtctgtaaatttataccctatatatgaatacgtgtctctaatttatatcccatatatgagcatataaatacgtgaaatacataaatccatgtgtgtgtataacatgtctgtctctcgtctctccgacccccgtgtatgatgcacgtataatatgtatgtacaacaaacacctcacactctgtctacacatctaaacacctaagtgcatgcaaatttatgtaaatgcatgtagaaaggtgtgcacaccatagacgtgtgtctgtcaatttatattccatatatgagcatataaatacgtgtctctaaatttatatcctatatatgagcatatgaatatgtgaaatacataaatccatgtgtgtgtgaataatatgtgagtctctcgtctctccgacccccgtgtatgatgcaagtataatatgtatgtacaacaaacacatcacactctgtctacacatctaaacacctaagtgcatgcaaatttatgtaaatgcatgcagaaatgtgtgcacactatagacgtgtgtctgcaaatttataccctatatatgagcatataaatacgtgtgtctgtaaatttatatcccatatgtgagcatataagtctgtgtgtctgtaaatttataccctatatatgaatacgtgtctctaaatttatatcccatatatgagcatataaatacgtgaaatacataaatccatgtgtgtgtgaataatatgtgagtctctcgtctctccgacccccgtgtatgatgcacgtataatatgtatatacaacaaacacctcacactctgtctacacatctaaacacctaagtgcatgcaaatttatgtaaatgcatgcagaaaggtgtatgcacaccatagccgtgtgtctgtcaacttatatcctatctacgatcaaatacgtacataactatgcacgtgtctgtatataacatgtgcacgaaatttccttgtagggccaacatatatataaacacacgcacacacatgtatgtgtcacatcgtcctacagacacacgtatgtgtgttctgtgtacatacgacatacatgtgaaagtccttctctacacacacgcataaccgttatacgtgtgtgtaacgtgtgcaccgctctataaacgcacaatggacatggttgtatacgggcgcatatgataatggagccacctacaatcctacaacgctgtctgttatgtactttattatatagaatatgacctatgaccctatgatagcgtttcaccccgtgaccggccgcacggatgaccccggtcccgtaacctcggccccacggagcccctggccccgggctgcaccgtctgggtttgcatgagtccctccgtgccgttcgcacaacgacgggaccgcctaacgacgcgtttctccgcccgtgaccccgccgtcaagcgacgtgattgacaagcgtgagcgcatgcgcgcgacaggcgtgcgcagacgacagcccgtcagtacgcgtgacgcacgtcggtgctgccgtccctgcaaacacgcacacgcacacctgtgtcacgcaggtctgcacgcgcgtatcaggggagacgctctgcacacattaggcgccacaggcatgccgcgctctctctgcaaacgctgaccccgtacagacgtgtgtgacgtgcacacgtgccccccggccctgctccttcaccccacgcacccctcctcccccagcccctcctcctcctcccccctttggtcccccggcgcagcagcccctcccccgggccgcatgagcgcggacccctcgagaggtgggtggcccgcctgtctctggtcctttgacccgtggccaaggggttcagtttgtgcgctcccttgtagaggcctggggttgctgggttcgcatcccgggtgtggacccgcacacctcccatcaaggctgcgctgtgacaccatcccacataaaagagaggacgatgggtacgatgttagctcagcgagacaatcttcctcagcaaaaaaaaaaaagaaaagaaaagaaaggaattggttgtgacgtctcttgagagtcacaatgcacgctctttgggaatgttgacaaaatttagctcttttcacatgggcaccacctgttccagtggggccttcctgagactgaccaaattcatcagccagtcaatcaattaatcaatcaattaatcaatcaacccatcagaatacaccaacctcaaaccagagaactcacaataggtccttgtgtgtccacacactcaggacgggcagagtcaagacccagggagcccacggcctcgagttggaacttttgtccgatgggccgtgcagatcgcatgtgtgtgcgtgtgtgtgttgcagactgaaccgtgaccccctaaaattcacatatgggagtcctgaccacaggaccttggcacgtgccgggatttggagacgggtctttaaggaggggatggaggtcaaatgaggtcatgagggcaggaaggtttctgcgagtcaagacagccaatccgtgcagagttttctttcttttcctttttgctttctagggaagttgattgaatttttaaaaacaggcagcaaataagtttcatatcgcatttcgctcccgtcaagagacagaaccctcctgggcgagttgtgttaagaaagatgctgaggacaaattctcggtttacgccaaatttgcttattcgttctaaggcctcctcatcacgggataatgacgatgttggcaaacggggggccgtacgtcctatttgagcccatctgggtgaccccaaaatgagtgtaggacaagatttagagcccccaaatgccctctggaagatgcaaggacactaattactgtgtttaacccacttgcatcaattaaaatccgcaaattaagacagtggcccacacccggccccccgacttgtttttgtcaataaagttttattagcacacaaacacgttcacttatctatctattgtttgcagtgacttttgtgctaaaacagccgagttttctaacttctccagacacactgtggtccggggaacctaaaatatttactctgttaccttttacagaaaaactttcccacgtccgcagtgaataatgagggtgaatgtggctggatgccttgcatgccaggggaaattttctcacagaacgagcaccgtttttattatcgtgttctccacggccgtgtgcagccgcctcaaaaataatggctctgaaattcttagaaaccgagaaaaaaaataaaataaaaagaccctcaaaaatacgatttaacggacaccgtcgccctcctaacgagctgaagaaaccgggttgcactcccagcctctcgcctcgcgcccttctgctatttttttctgcacaaaaccacatgagcccgtcacctccagacccgcaaaagctagtctgaaagttcctagttaccttttaaaaaataaaaaaataaaaaatttttaaaaaaatgaagaacccgcctgtccaaacctctgacggttggaatgggcccccgacttcacaggcggcctgttgttgctgactgactgcttgatgacgggcgctggagggccggctgcttttccctccgcgggataatgggaggccattaaaagggaatagaaggcgccccggccatataaacgcagagcgtttgttgacgaacggcgtctctgggcctaattgatgactgcgatcatggcgatgatttagagacgataaattgaaacctattaggatttaatgtaaaaagctctaattagtttgctggagagaggagggcaaggagcctcgcggagaatccattaagccaattacgacgtgagcgcggcagaaaatacccagccggctgaaacacaccccccccacaaccaccccccggtctcgccccgctgcccccacaccccctccccaaccccccgagcgcacagattcatctgtcacatctttccttaattgaataaacacatccaggccaaaagatgggagagtgccttcaccatggtaattaatgcacgtgttgggcgctgggggttggggttcgagggagaagggaaaaaaaaatagatgtatgtgtttctgcagagtaattatcatgcaaaacgattcaatcgacagccgaacgcccaccacgcgcgcgcacgtgcaacgagctgcgccgcagttccgcagcgtggccgcgaatgcgcgcgctcgcgaatgcgcgcgctcgcgaatgctgagacgcgggcgggaggaggggcgcgcgcggctgggaagctcagcgaaagcgctccgggctattcccagaagggtgaaaacacacccccccaccaccaccaccacccacccaccccaccaccaccaccaccaccacctccccccgctcccagtcccccgtcccaaggcaattaaaaaatatatatttaaacaagccggtaaccgctgttgcctattgactgtcaaattaattcagtcgctcgggagatgccgtctgtatcagccgcgctgcgcgggtgtcacccggctttcggatcccggcagccagcgagcccgccggtgtgtttgatggctgtgataatgggaacaagataagcaattgcaacagctatatcatagatttcctcataattacctgacctgttccgctgtgtcagtctggcgccaaacaccgtgtttttatgtcggaagctgtatgggcattttcggctttgatcatcgggtattctgcagatgtcagcctcgctgtattttaattgactctgggggtagcgttgacaaagccccttcgcctccccttcccggagcctgatgagcctgacaagctggcatttcgcgacgtgaggcccgctcgcaacccagcctcccaacgtggggggggggagcaaaacgatgtcaggagacctcacctccacctgcctcccctcgctccccgccgtcgcagagtcaatcagcaaacctagggctgtgcgcacccggccccctgagcctgtggggctggggcccccctgaatctgaggatgccaggtcaccaaggctgcgggccggtggtcctgaccccacccgggatgcaggccccgtgtgcccgtcgccccacacccccgccacgccggcctccgtcttcttgcacctgacgtgacagggaccccgataatgagcagccgggcctgtgcgtgtcgatggaggcccttaacggcccgtcactctggccttcttaaaaaaggaaaaaataaaaaaatgcagcgggtgagtgccgggtgcaaacgtctcgacgcg

SEQ ID NO: 103 - DNA, 12347 bp, Equus caballus
atccatccatcatccatccatcatccatccatcatccatcatccatccatcaatcatccatccatccatccatctatccatccatctatccatccatctatccatccatccatccatccacccatccatccaccatccatctgtccatccaccatccgttcatccatccatccatccatcatccatccatccatcatccatccatccacccaacacacatttactgggccccgtctgtgtaccacgcatactccaagcacagagacaggattccaggcgctgccctcttggagctcaccttccagggcagggggatcgccaacaaaattgcacaaaccgaagaacaatgagacgtccccgcgagtgcaggagctgggacggggctgtgggataaatctgctctctgtatgcatgtgggaatccagcctcacggggtgaggagggtgggcccgtctccagatcccggctctggtcctgggcgtcagcgggttgggaaggtgcaatgagacagacagacgagtagatggggtgaggaccgctcccgccatcccacatttgcggcccacgccttcacctccgtccactcttccctccaatctcgccttccccgtgaagcccatcctgacggccccattggacgtgtctacccacttcctgctccaacactcttgaccttccgcgtcctccattattttttttcccctccatgggccacgttaccttctacctggaaatccagtctctggatccatttctgtcctacggcctcgaatgtcagctcggcaagggtcgtcgagcgggtcacgaacatgagcaagaccctaaaagggtgcctggtacctagaagccgacccataaagatgtttgcagtggggcctccttattcgtgtctgtaaatccagatgcaacaggactttagcaaggactgttgattggctccagggccgagaaggaggcctggtccacacaaggtcatccgatgcgtaaatgtttgttgaatgactgacggggaaggttgagaaagatacagcctgagaggagtgctttggagaggaggataaagacgtcattggtcattgacaacaatgaggccattggttattgacaacaatgaggccattggcgcttgacaacaatgaggtcatgggcgtttgacaacaatgaggtcatgggtcattgacaacaatgaggtcatgggcgtttgacaacaatgaggtcatgggtcattgacaacaatgaggtcatgggcgtttgacaacaatgaggccatgggtcattgacaacaatgaggtcatgggcgtttgacaacaatgaggtcatgggtcattgacaacaatgaggtcatgggcgtttgacaacaatggcgtcattggccattcagggcgagggtccctcatggggccacagtttgggggaagatgttgaaaagcaacattcagaaaacagaagcgccactttcttcaggaggacgctctcgaaacacctgtcattccgatggtgtagacagatcatccagtcctttggaccccacgcgatatatcccaatcctctgggtcccaagtgtgggtggaaacctcaacgagcctcctcctgtggatcctcgctgtaggaactgagccctgtggacctcagccctctgcaacccaacacgatgggtcccggccacacacatcccaactctgcggatcccgtctctatggattccaactctttggacgttagttctttgggtcccaaccctacgaatcctgatcctatgggttcaaccgtaaagattccaaccccatgaatccagctctgcagatccccactctgtgggtgtcagtcctgtggagcccaacaccgtgggtcccatgtctacacattccaaccctatggatcctgagtctatggatcccaggtgtggacatggcaccactcagcaagccatggcaggcgtcctacatataaagtagaggaagatgggcatggatggtcactcagggccagtcttcctcagcaaaaaaaagattaaaaaaaaaaaaggaggattggcagcagatgttagctcagggccaatcttcctcaagaagaaaaagggataaaaacccagcctcctctctccttacgctgcatcccacagcaagatggcccacgcggagatgaacagcatcgtgcgcgcggggcagggacttaaaaaaatccagatcggccgtctcttcctggcggtgatttgcagttcaagtccgacatttttgctcaaacgttaaaaagaagaagaagaagaagaagaaaaaaccgggcgcgttagcccaggcgtttaatgaaaacagagccgcactcaggcaacgtgctaacaaggagcagatggcccgtcgggacccaaaccctttttctccttgttgccaagcgggccccacaaagccgctctgtaagtggtttcataaggacccgatttggctcggccctaacaaggccattaaatctgtgtagacggctgggcggggtgcaaggggggtggatgacaagaaaacgggaacagcgtgtgtgccgctcgcccggcctcggagcgcgaacccccaccgcgagccctgccaggacgggggagacagaaacggccgcctcgaacctgctcccacgcgtggaacctaaaacttttgttgactgaccccgtgaccagcccctgaaaccactcctcccatttctgtctgtggatctgcctgttccggacgtttcccgtaaacggaatcacgcgctgtgcgtccttctgtgtccggcttcttttccaggagcaaatgtttgcaagattcacccgggtcacgtcctgcttcccgcgtcccccccgagcagacgcgcacggaggctcccgactctgacggcttcccctacggctgagcagtgagaggtggactgcaggcatggctggatcaaggcgaggggaggaagtaatgaaacgggttttgtgagggctccactctcgccaccccctccttctgccccacaaagtgagagtccagcaggtgtcgggcgcccgggctttgtctctccggccatgaccatcgactgcttgaacccaggggaaaagaactcggcaaaaccggcaaacaaaaaactcggcaaaacaaaacaaaacaaaaaaagaggatgactgacagcagatgttagctcagggccaatcttcctcagcaaaaaaaaaaaaaaagagcaagataaaatcaggcacgatatccatatctgcttggaagaaacaggactcacaggaacaacacttcccctcgggtcggaccggtgtagacacgcccgttgtcaggaacgcatggcctaacggggccccaggaccccagaaagcgcgcgggcggcggcgacacgaatgatcccccggtgcttgcaaagcggctaataaacctctggttcatctctgcggctgcagcgctcggctcgcttggcagctcgggcacgtcctgcaaacgagccccctcgttagcgcgttggtgcaaagggcaaagggcacaggtcacggccgggcccacctggggagggacatgtgcagccgctgcagaaacctccgcggcgtagacgaacccgggtctgacccgagttccgggctcgcaggcagcggggacccggcaggtcagctgcggggggaaccggcgcatgcagagaggatgcaccgcgcatgcgctgtcgggcacagggcacatccgggtcccggagtcgtgtctgtgagtcggctcccagctccccgggtgtagaccgtttatgcagaaaaggattgcattccacacacgccgcccggcggaccccaagctgcttgcacttcgaaacctcttaacccacttggcggcggtgtatacggtttgcagccgtctgtgccccgtttgaaaacaggcaacgggggccgtttggacgaagactcgcagccgtgcaatcactgcacgatcagatgcgggttattctgactccacacacgcctccaaagtccttattccacttgcctacccgtttccccccaacccaattgcaggcttgtgcattttccgtctccttccagctgcgtggacacgttagtggaaaacggctccatgggacgctggacgttcccgcttgccgagaagccgtcaaaccgtttttccaaaacggtctgcgccattttgcgtttgcgcccgggccgcccacctcacttccggctgctccacgtcctcggcaacgctggccgttataaacgctccaaacggtcgccaccgttagcctggggtgtgcgctttgtgttgactcctcattgactcgtaatatcttctttgttacgtatttggcacatcatcagatacataatacaccgggcgctgtgtagaggcaggtggtggggttttttttttttctctttttttcttgaggaagattggccctgggctaacatctgctgccaatcctcctcgtgtttgtttttttttttttgctgaggaagacaatcctcctctttttttttttttttttttgctgaggaagactgaccctgagctaacatccttgcccatcttcctctgctttttatactaggctgggcacaacatctgacctttgatggcttgacccctctatgcgaacgggccgggaccccacaaactctccggtcggccttcaccccccacagtcgcaccctccgatgccctgaaagctggcctggctcaggtttactgtgttctcgcgggtcagggccattaaataaaacgtttacaagccgcccataaaacgtttaaaacgcttggaacaacgcccgtgaattaaaccctgttccccttggcgggaaggaggcggaaatgacttaaccccgggcccgaaaccacctagtgaggcggcgcgagccgggctcagtcaacctggaggggggtctggaggccccgctcacctgcgccaggtgaggcccaatggtttccaatatggcggcaccgacgggcgtgaccccggccgtgagccggggatctcactcacgcgccttccccagcccttgtctgacccacaattctttctttttaaaattttttgccgctcaaatggggctgaaaagggcatctcggctcccaactcgagttccagggcccctgaagacgaattaaaaaaactaccaccagccccaccaccagcaccaccaccaccatgagacgggctcaggcttcagggggctcctggcaggttaggagaaaagggaacacctccttttcattcctacttcagaaaatctgtcgctgttagccccaaactgtccggcgggctggcaaactcctattcaccctgcagagccccattcgcctgacccctcccggctcacctggatcgtccagaggaaaccaggctgagctcttcctcccgcgttctactgttgacccccgggcctgatctccaccccgttccgtttgcgcaggaaacggcctcctggctcagctcccctcctccgccaggcaccccgattggacgaggagtgttgccaggcccggccccaaaggctgttccatccagatgtcacctttgcccccgtccaacgtccaaaatgcacacggccccctctgacccgggtggaaaaaacccgactcaggccgtggtgagggtgacctcggtgtcctgcccacacggggtcatcagagccggcaggtgggagacaccatgcaggggaggggcagcttttaggagggtcctaggggcgtgacatttgaccccagactgggggcttaaaacatcagagatccatcctggcctgaagtttgatggttcggatcccgggtgtggacggacacgaatggtagctcagggccagtcttcctcagcaaaaaaaaaaaaaaaaaaagaggaggaggattggcagcagatgccagctcagggccagtcttcctcagcaaaaaaaaaaaaaaggtaaaaaaaagcacctttatgatcccaacacagccatggacacctgagattttaacatgactaagtctttgagctctcttcatctccagttttcttttttttcttttgaggaagattagccctgagctaagtgctgcctatcctcctatttttgctgaggaagactggcccgcatctctagtgttttttttttccccattcagaaagcaaccgtcttctcccctttccgtcggcctctttgcaaaaggggatttgtgccaacaggtctccgtttccactccgcgtccaacaaacggcagaatgtccaaggaggaaaaaaaaaaaagaccatcaagtagccactcaaatcccgcaggaaaaattcaatcaagcatccagcatagccgaccccgccgagcggtcggaacagagactccgggccccgtgatgacaaacacaggtgctgggcggcgggtccgggtccccgggatcctattagcagctgctctgggacttaagaggatttcgaggtggctggtcgagtcgggagccgacaggcggagagagggacgtgtgcagcgctcgggggtcgaggccgcgaaggaaacggtgatttatgggccgggtaataaaaactaagcccggcctctcttctcgggcggaagagaaagaactgaggattggaacaacacctcattgtgcccgagctggagaaaatgaacgaacgctggacgatgctgttttttttttttttcttttttttttctgaggaagagtggccctgagctccgatccgtgcccatcttcctcgactttgtacgtgggacccgggtggcgcccctcctacgaggtccccagagtcgaaaacccagagacacagaccgtgtggaccatggagcaggggcggtgggaggcgacggggagtcggggtttcgtggggtcagagcttcaggtcgggaagacgcaagcttccggaggcagatgggggggacggctccccaacctcgtgaacgtgcctcacgcccccgaactgtgcccttaaaaatgcttaagacggggggccggcccggtggtgcagtggttaacggggttccctggttcggatcccgggtgtagacatggcaccgcttggcaaaatccatgctgtggtaggcatcccacatagaaagtagaggaagacgggcacggatgtgagctcagggccagtcttcctcagcaaaaataaaaaaagaaagaaagaaagaggagcattggcagcagatgttagctcagggccaatcttcctcagcaaaaaaagaaaaaagaaacaaagaaaaaagaggcagattgacagcagatgttagctcagggctaatcttcctcagcagaaaaaaaaaaaaaaacccaggaggattggtagtggttagttcagggccaatcttcctcagaaaaaaaaaaagagagaaaaaaaataaacttgatgcctgagctcctatttccactgacccggcagaaatgtgaaaccttgcagagttgggcctgtttcacaacttaattctctttaaggggaaggaaagcttgaggggagaccccacccgctctgcccagccggtggcctcgccgtggcctcggtgacaaggacaccagccagctggatggacggggggcggggaacgggagccagaagggtctgctcactgcccgtttgctggcccggaactgccccatggggccaactcggggtggggcagacacttcaaaattcacacaacatggggtttgacctaaaaccagaggacacttttttttttttttgctgaggaagactggccctgagctaacatctgctgccaatcctcctcttcttcttcttcttttttttttttgctgaagacaattggccctgagccaacatctgctgccaatcttcttctttttttttttttttttgctgaggacaattggccctgagctaacatctgctgccaatcctcctcttttttttttttttttttttttttgctgaggaagactggccctgagctcacatccgtgcccatctcacaggagagttttaaacgtgccaatcgcccacacatcctgcaggagccgggaagacagacagaaaccgtccctctgggaaggtcggcctccacgtgttgacctcgatgacctttagctctttgcaccctccccggaaggtcagtgtagactgtaggatggggctgtagaaccaacaccctttgtggacccgcaggatttttctggaacagagacgcccgggtccgactccctcctctgtctacacctcctgccgccctttctggatcatcccttcgaggctccaaggcgtcttctccggagatttctttccccatcgatccccttgggaagcatttcacggtccacacagcagcacagaggacattctagaagttggtcgacggggagctgcctctcgggggcgattgcgagtccctcgatgtcacgctgtggggagcccggctctccccaaaccacaagaaagagctccaacccaccccgtcgcaccggtggcatttcctccgtggagacacggctcctccaacgggctcagagaggttgggggcgctgggcagacgacacagggaaccacaggaccttgttctgtcgggtcatttgtggatcttggttcccttccacccacacagccaaaaatcacgttggactcgtctacacagggtgtgagccaagccagctccgtgcctggaccctcagccatgggtggctctcctttgacgacccaccctcagcagatgacgacaccacgaggggcgatggaggcccagctccatttctccgtgctcattccttcatgttcgttcttggagctcactgtcctgcgcttggctgtggggtctgtaaattaactccgagtgggtcacggagttttgaacacaggcgttgacactgagagctgaaatcatccccgtctgccgtcttttttcaactcctctcaggatgagtctcatttagggtcagccctgtggcgtttcaatgccaaccctactggttttttttttttttttttgaggaagattagccctgagctaacatctgcagccaatccccctcttttttatttttatttttttttgctgaggaagactggccctgagctaacattcatgtccatcttcctcgccgtttgccaagcagtgtcatgtccacacccgggatccgaaccggtgaaccccgggccgccaaagtggaccgtgtgaacttaaccactgcaccaccgggccagcctccccacccaggagtttcgacgtagcttctccatgctggtcaacggcagcctgttctggcccgaggggcgttttgtgacccaacggggaccccaacccaccacaaccccggatccagcctctcgagggcgccccgccctttccacaggcccaagttttatttcccgtaaactgtttattttccgggaagattgatgcggttaatattagctttcaagatgacagattaacacggccagttaatcagggctattagcggataaatatcggtaattcgatcaccagagtaatttctttcccgataatgcgatttacaaacgcaagcgattaagtaattagcctacatctccatagattacccgacctcgggagctctccccgggtgaggacagggagcccggcgcgacttagaactcgactcaggaaggaagagaaaactctagagaagcggggccggcccggtggctcagtggttaagtctgcacgttccactttggcggcttggggttcgctggtttggatcccgggtgtagacatggcactgcttgtcacgccatgctgtggtaggcatctcacatataaagtagaggaagacgggcacggatgtgagctcagggccaggcttcctcagcaaaaaaaaaaaaaaaaaaaaaggaggaggattgtcttcctcagcaaaaaaaaaaaaaaaatcaattcgcttccttgaatggtgtggcttgtgtgggcaaccgaggcaggggtgagccatgacgggccatcaccgggtgcgtctcaggccgcaggtctgcgagcctcggtccacactggcggccccgagtcggctgattaatatgggcttccacgtgcctcgcagagctccgtccccccggtgtctgagccgtttccgtggtaaccgagtcggaacgcggggggcgccgggctgttgttctccgcccctccggctgccggcggagggtcccggggagccgcttcgtccacgcagcccgtcacctgtcagcgccgccagacgccccgtttgatcacgccgcccgcccccgtcccgacaacgcccggcgtccgctgatcacaggatccggctaattcagggcgctgtgtagaccccgggggagccagtacccccggacctgccagttcttgtctcatttttcctccgcgaaagccgacaggctgtgcgaggacggaatggtcgatccgttagtttctgacgggaggggttcgggggggccctccccgcgggagtctggatccgcttgtgcttccgagttggtggggaaagactcggcagcaagcacccgtgtggtgggcagaactgagtcccctggctcgcgtaggggagccctgaccacaggaccttggcacgtgccacggatttggagacgggtctttaaggaggggatggaggcgaaatgaggtcgcgagggcgggtcctgatccagcgggactgggtccctgatgagaagaggagatgaggacgcagacggggagaacacgtgtctacacggcgatggggtgtagacgcgtccccgggcatttcgtggcagcctcgagaatccacgtgtttctcggcagccaggatgctcgctccctcctccacctggagagcagtggagacggggggagggggggagggggtcacagggcgaggagggggcattgggcctggtgccctgttggggagactgaggcagattcccttggagaccaggggacggccatgttttcagctccatgtaagatgctgacattacattaggtttttcttttttcttttttctcttttttgttgaggaagattggccctgagctcacatctgctgccatttctcctcttttcttttctgttttttttttttcgctgaggaagactggccctgagctcacatccgtgcccatcttcctctactttctatgtgggacacctaccacagcacggcgtgccaaacgctcccatgtccacacccgggatcccaaccagtgtcttccaataggatgcagacggggtgggaagcataaaacctgggcgcatgggctgtgcaaccttgggaaggccacacaccctctctgagcttccgtttgtgcatccgtccatcgggggggcctggactccgtgatttcctggggtgtctcctcgtccacactgctgtgagccgactgtcgggatggtcggtccacgcggggtgtgagcgggtgttcagagaggctgtgcgaaaaagcggggggtttttttgtttttttttttaagaccgcatgctggcccgtttcccggcgctcgggttctcaatcctccaccttccagctcgtaaaacgcggccctcaaagcctcccattccaccccgactcccgcggttacaaaaacgccccataaaacccgctcggactgacacgcttccaaattctccgtgcatccgtcctgccgacgtttgtcctgtgacttgtcgcccgtcggcgtcggcgtctttgcggaaacgccgagctgggcgaccctccgcgacttgcttgacgtctctgttccctttttgcaagggccgcgtccacaggagaaataatctggttttccgggccggttgcataacgggtcctgaccccccaagtggaacccgaattccgacaccgaccacccattgcgcccccgggacccaccggacccccatttggatgcgcctccctctaagtgggcctattttcttcagagcgggagggggtgaaaaagcgctgggaggagaccccacgccgaacgggacggggccgcgcgaaccccgagccgcgtcattaaacccttacaactcggagatccggctttctcgggtttcaacccgtttccccgtgcacaccggcgggggcgctgactcatcgcccataaaacccggtttccaaactcgggggggggggtgcggggcccgcgggtttatggcgtttcgggccgactcgctgtgtggcctccgggcagccgggcccgtctccaccgcccgcacgcaaactgcccacgcggccccaccgcccgccgctcgacctcccgcggagccggcggtgtggacgccgccatctgaggcacggcgagcacagagaccccgagagcactgagcacagagaccccgagagcactgagcacagagacgctgtgagcacagcgaccccgggagcactgagcacagagaccccgagagcacagcactgagcacagagaccccgagagcactgagcacagagaccccgaga

SEQ ID NO: 104 - DNA, 1984 bp, Equus caballus
tttaccccgccagaccaaccccctccgtcctgccgcccgagtgagctcgtcgttttattaaaaacacgtgaatatgtgtttgtcatcacgccgctttcgtggactcatacccagtctttatcccccagaaatctgtcgccgtttccaaaccagaccttttctcttcgtcgtcccgaccgcgtctttaataattaatttccgcgttgggccctgggagcgcggggccgccgtcctgtcgaattagccccttcctgcgggagaagcggtgggccgcacctcactcgaagatggagcctcagttcttgacggctgggcggctggggaagcacggactcgggaccgtgggattgggaatcccactctgattgtggggttgaccccctcgccgtgtagacacacacacccccatcaagagggtcccttccagggcaccagacgagattaaaggacccagataagaccgtctagacgggattatccgcgtggggtcagctcacagacccacgggaacctggaaggggcctcgaaggacaaagatgcaacaggacctgatgatgcacgaggctcgacgggtccgccctgaaaagcgaccctgcggggccccggcgaacgcagctcaaatttccccccttctctgactgcggggcgttttttaaaaatcccaataaatagggtttgggtgattgccaaagtgtgttatttggtcccaaaggtaagatttattttgcaaaggggaatgtctgcacctccttgggtcgtaagttctctcacactcgtgttttcttttttttttttttttgcattcagggcccttattttgtcatctctcccgattttcccctaaaagcagagaagcctcctccgcacctgttcgcagcagccaaaaggtgggaacagcccaagggtccatggatgggaggatggataacgaaaatgtggtccatcgatacagtggaatattactgagccaggaaaaaggaaggagattctgactcaggtaataacatgcatggacctcgaggacacaatgctcggagaagtcagccagaaacgagaggacaaatcctacaggattccactcctgggaggtccccggaggggtcagatccacagacacggaaaggaggacggtggtgccaagggcctgtggcaggtggatggggagctggtgtttcgtggggacagagtttcagtttaagaagatgggaaggtctggagatggatggtggggacggttgctcaacccatgaatggacttgatgcccttgaaccacacacttaaaaattgttaggggccagcccggtggtgcagcagttaagtgcgcacgttctgcttcggtggcctggggttcaccggtttggatcccgggtgtagacatggcaccacttggcaaaagccatgctgtggtaggcgtcccatgtataaagtagcggtagatgggcatgaatcttagctcagggccagccttcctcagcaaaaaaaaaagaggaagattggcagcagttagctcagggccaatcttcctcaaaaacaaaataaaataataaaaataataataattttaaaaataggaaatgatgcccaaaagattgtgcatgtgcaataaacacagtttttggactcagaagataacttgaaataatataaacgctatagaaaatgattgtgaaactagaagaatgacaagaacaaataaagaaaacagatggtgcccttaaaagaaatagagaatgaaaaagggggaaaaaggcgaaaggaagtgaagcaggagatggacaagattaaagaagaaacgataaatatggaaaattagcgaatcaggtcaaggcggttcgatgaggaacccgcaaaggagaaaatgaaagagagacggaacgaaacaaatcatagaaacacgatgcggaaaagtgcggaggtcaagattccaaactgaagactgaaaagacacacgagaccgacccaatatgactgaaaataacgcag

SEQ ID NO: 105 - DNA, 1942 bp, Equus caballus
gcggatcccgggtgtggacatgggaccgcttggcccgccatgctgtggtaggcgtcccacatataaagtagaggaagatgggcacagatgttagctcagggccagtcttcctcagcaaaaaaaaaaaaaaaaagaggaggattggcagcagatgttacctcagggccaatcttcctcaaaagcaaaaaagaaaaaaaaaatttgatgtccatggaccagtcactccatcggccacaggatccatgggaattcctttgacaccgagcggtcgatcctaatcggatacctcgatggcttaagtaatgggccgagtccgtcttaaacatcgactcgtcagacaacctgggagcctattaatgtcccgtcaggccgtctgtcattttgtgtcccgggaactcggggcgacgtcgcccgtccttttaatgccccggccgcggacgctcaaggcctccctttacccttgagaggcgagtcacttgactccagaggccgggtctccaaaccgtgcacttgtttccccgaaatggtaatcgattgactcacggacgtggctccgctaagtggaaacgccggggttgaatttgacgggcgcatcctgggggtaagttgaggcaggatgtctcgggtgacagagtttcctgcgttggagccaaatatcttaaaggggccccgggcccggagttttccgtcccatgcagccccaccagatggtctccaccgcccgccggggcctctgcaaccgactcccgccaatgaggaccagatgtcgccccgtctttatcttaacaagccccgattcctattaacccggaatttgtcctgcgttcgactcggtttgatttagtcctgtctccacgtcgaagccaagaaaaaaaaaagaaaaaaaaaaacattgagtttaaaaattacagagtcggggggggaggtgggggtgaagggaagaaaagaaaaaaaatgtggaacacatgctcaaccctatttgtcgagcagacaggaacatccattaggattatatggatcggtcgaggccctcggcagccctttgaaaatacgttcctgacgggcccggctcccggcgctggccgccgcgttcccgtttgcctcgatttcccggctcttgacggacggcgacgtacgaacgagtcagttcggtccgttgaactagtttctagggtcggcggcccggagtctctgcgaaattggagaccaggaacgtgtcggccccgaggaaatcgaggaaaatgctcagcgtcccggtgactcgaatagacactgaggttctggaaggggcccctgcggattaaaggtttcctgaaggaatttggaacgtgaggagggaaaaacggagacgtgcgacgtccgaggtgggacgacgggccgatcagagtacgcgggtaattgctaattattcatggcctctcggccatcagttgagctggaaacgctcaaccccgtttagccctgaggtaactactgccaatcctcttatttgtttttttttttttttttttgctgaggaagactggccctgaccacctgctgccaatcctcctcttttttttttttttttttgctgagggagactggccctgaccatctgttgccaatcctcctctctctttgtgtgtgtgtgctgaggaagactgggccctaaccatctgctggcaatcctcctctctttttttgtgtttttggcaccaaataggaaaacgttcaggaatcgagtttctaaggaacgtggtcgggagattggaaaaagaaagacgctgagatttgtgacgcccatgaagaattcttaagtggagaagctggttggcccccgaaatggaacgggttcatcctggaaatatgtcgatatttccccaaattaaaataatgggcgtaatccctgcaggaatgctttctcctactttactttttttttttttaaaggggggaaatc

SEQ ID NO: 106 - DNA, 2724 bp, Equus caballus
cccctcagtcacggtccgaacgcttccaggagtcggaggactcctgctcctcacccccaagaaaaagggattgcatgcccagcgggattgacccgaggggccggcccttgaatgcacgtttgcaaaatgcctcctacgaggcccaggatgcgctcagatggcaccgtccatataggagcatcgggttcccacacacgtcccgtggacacatccctcaaggtcttatcacctccctggcacacagtctgggggtcgcagcccggcgcggcctgggggtcctgctggggctgggctgcgtttctccaccccgttgcaagtcccaggggcaaaagcagcgccatctgcatacgaaagactcggcacaaaggccggacccccccccactccccacagctggtctcggcgggggtccccgggcgcctctttgtgtccctcacaatgactccgggctctcggctctccgtttgtttgctcccaggccccaagcaaacggccaacgcgattgttcgtcgctgagtgtttgccctgcggacgggccctctgggtcgccgttaatcagaccgttttattcgaggcgggcgggaccggccccagtcagacaagggaggagggcagcgttgtgcacagatccagagggggtctgtctttcagggtttttgcagcctcggccctgcggacgtgggggcggggccacgctctgtgctgggcgtcctgggcgccgtcgggggtggggcagcctctctgggctccaccctcgagatgtcaggagccgcctcccaggtccaggcctgacaaccagaaatggctgcgggctaggcagagtcgcccctgggggcaaaaggaatccagtcatgaaacgcggacatacggggatgggtagtcagccagctgcatacgggatagatggagtgtagacagacggagagatggatggacggatggatggatggatggatggacagacagatggatagatggatggatgaacggatggatggatggatagatggattgattgatcgatggatcgatagatcgatagatagatagatgcatacatggatggatggatgggtggatggatggatggatggatggatggatagatagattgatcaatcgatggatcgataggtcgatagatagatagatgcatacatggatggatggatgggtggatggatagatagatcgatggatagatagattgattgatcgatggattgatagatcgatagatagatagatgggtagatggatggatggatggatggataggttgatagatagatacatggatagacggatggatagatggatagatagatagattgattgatcgatggatcaatagatcaatagatggatggatggatggatggatggatggatggatagatagatggattgatagatcgatggatgcacagtgcacggcttgcgtttgccaataaagttttattgacacttccgtttacacatcgtctgccttctgttggagggtaaaaggagctgagttcctggacctcagaaccccctcggggtcgtgggacccagacgttggacgaatcggcccccggggagggtccgacgcctctcgtccctcacaggagagtcagtcccgcgccatctgacggctcagacgcatcatcccccgagcccggggggaccagcttctcgagggacgagtcccacacggggacccgcgtctctggggtcacggatttcaccgtagcttcattgttttcaggtccgtcgtccctaaaagtccttttatcctagagaatcctaacgacctccacgggaacacgagctcctccttcttcatcttcaagttgctacaaccgtgaccaacatgggccggggccttgaatgccgggatcactcctaagtgaccagagatgccaaatattcaacctcattcttaaacggctgaaaacgagctcacccaggaatcccgagtcttacagatcgaagataattcgccgtgtctgcaaaacccccgtttctaacccaaaagggaggttttgggcgtcgagcgtccccagatgtgctccctcctcagaaaccctgcagtcgcttatcttttcaggtttctctgcgttatcccattaggaagaatgtccaaatcacggagatcctgtaaaggtcgaattaagcttgatgggttccacgtttttctccccgatccgtccgataagcgtaaaatcatgataagcatcgcattttgggtgttttttttttttttttttggaacatttgtttccatttctccttaaacggctgcggcgcacggctgggctccgggcggacgacgtccgtctctgttccgaccaggccgctccggtgctcgggcggatcccgaaccctgacggacaaacgcagctagtcgtgcgggtgtttcctcccggcccaaaggggggcgagcgagtcaggaacagcaccgccctgcagggagggaggggacgggggaggacgatgacgggaggagggggaggaggggaggacggatgggaggacggatgggaggacggatgggaggacggatgggaggatggatgggaggacgaatgggaggatggatgggaggatggatgggaggacggatggggaggacggatgggaggacggatgggagggatggatgggagggacgggatgggaggacggatggggagggattgggaggatggatgggagggatggatgggagggatgggaagg

SEQ ID NO: 107 - DNA, 3015 bp, Equus caballus
ctctttttctttgtaagaggcgtgattaaattccccccgcactccgtgttttttctcggtgcctccctagctggacctccaagttgcttctgcatttttgccgagggtgcatacgataaccgatgcatgagtctcctccttcggatcgaagcccccgcgttcactttctttgggggactacgctacgcggccatgtcggggggttccgagggtccataataacctgtcattttctcatatttcaacagcaaacatcatgcgatttcattctgcgaaggagtccgggggccgactaacgagaatctttccactcatccggagtctcaggatataatggcccagactcgcgggacccaaccgtgggtccgtccctcgtcttggcagacgttcctctgaagcgtggaagaaaaccgaaaacgcttgccggccccgagaccgctcctccctccaccacctttactgaattattcatgcgctgttccccgtgtaggaacaggaagcccgggtcgcgttcggagatggagattttattatttatacgccataaatgtgttcatgaataattgaccgcggtacatcgacggcgcgcaaacaaatagagcgaattattaatttatagcacgctggggggatccataaaaccccagtaaacacactctttaatcaactatagacttttaaaagccactttacgcgaaggttcacatcttatgtatccatcgccccctaattgaatatttatatatttccatatgagctgatatcagtgacaccaagaaaaaaagaaaaaaagaaaaaaggataaaggaccgtcgccgaaacgggattcagcgagtggatggatccaccgtgagttcatcccctaattcggattctgtttctccatctagaccagcgacggtcatccgacaggatcgaaaatatccggttccttgacaccctgtccgtagacgcgtatttgacggcatgcatttcacagcaaggacccacctcaatccacttatttttttacttattgatttatttctttggcacgatgaggattgaaatccagacgtcgggtctggagctgcaaaaacgtgtccatcacacctggcgtttgctgtgcaaccaacggccctggggctcagagacttcaaacaagcagcgttgatttcttttctctcgagtgttcgcaggctgtgtggacggagcttggagcctcggctgttctggaaggaaccgggcctcactcgcgtggctggaccttggtggacacggccggacgttggggaccatggtggggcctccccgcgtggtctgtcaacctctcccagtgtagacgatggagctcctgatgtccagcacttttctagtcagccctgacccccaggagtcaaactacggccgccattttgcacacggtctacacggcgatgcttcctgcacaagagttccaatgaagcccgttgttgaccctcatggatcaggtcataaacccaacggataagctcattgtctacaatgtcttcccgtttgcggtcttgagcggtgactcaagataatcctgaagatgtggggggtgggtgttgggatccgtggaaggcaatcccaagacaaagtaactcacttacagaaacggatccggtgtcttcagggcacagggtgggtctcctcttctgtctctgaggacgacgctgtccctggattcagggccgcctcctctaggaagccctcctctccacccttgattcagggccacctcctccaggaagccctcctctccacccttgattcagggccacctcctccaggaagccctcctctccatcctggattcagggccgcctcctccaggaagccctcctctccacccttgattcagggccgcctcctccaggaagccctcctctccatccttgattcagggccgcctcctccaggaagccctcctctccatcctggattcagggccgcctcctccaggaagccctcctctccatccttgattcagggccgcctcctccaggaagccctcctctccatccttcccctcatcacggatttcgccacaacacggcctgaaaatagaccaagcgaaaggtagacagaaccgtcgtgcagtgtagaaaaaagtgagtatttgtgctgggtccataccacgtcccccgacagaaaccgctggatccagcaggtgaaaaacatacagtaatacggagaatttgaacaacgtggacgcgcacgcggataaaacgaaaaaaacgcccgttctgccaacgcttgtcggaaacagcgtcaaaaaataataataataataataataaggaattcaaacacgaaacaaaactccgtctcttttccaggatccacgtgatataaactgagatttctgaactgagtagaagagagtttaaaaatcccaaatatttggtacttgaacccaacgacctttctgttaaaaacagaattgtaaagaaaaccaattatccctcagacctgaacgacagcgagcaattcagcgtctgcggaaagcagcagcgtttacacggttcgtcccccaaacgctgcagtttcctggaaacacggactctgccaactcagtccaggaagacgcagaaaatgccgaccccaacctgaaaatttacagacagaaattgcaagaaaagatgaaccctcgaagaccagcacccggggccggcccgggggcacagcggttaagtgtgcacattccacttcggcggcccagggttcgccagtttggatcccgggtgtgggcatggcaccgcttggcatgccacgctgtggtaggagtcctatgtataaagtagaggaagatgggcacggatgtgagctcagggccagtcttcatcagcaaaaaaaaaaaaaaaaaaaaacagagagagagagaggaggattgacagcagatgttaactcagggccactcttcctcagcaaaaaaaaaaaaaaagggaaggattggcagcagatgttagctcagggccagtctttctcagcaaaaaaaaaaaaaaaaaaaag

SEQ ID NO: 108 - DNA, 1396 bp, Equus caballus
tttcctttttcagggctgagtaatattccgttgcaccgatggatcgcattctctgttttcgttcgtccatcgatcgacacttgggttgtttccgtatcttggtgatgtgaacatgggggtacggggacccctttgagatcctcatttcaagtcctcgggggggggtgggggcgcaaaataaagctcaggaggaagaacccactttgcaaggcccaaaggacaaggagaatggctgatatacgaggattgtatggcttttctggggccatcaccgcaaattccccacacggggcggctaacaccactgacgtcaatggactcatggtcctggaggctgcacgtctgggatccaaatgcaggcagggctggatcctcctgaggcctccctccttgccgtgtagacgcgtcttctccccgtgtcctcacgtggtcgtccctctgtgcgtgtatcatctcttcccatcaggaccccagtcctggtgcatcaggacccacccccatgacctcatttgaccgccatcccctccttaaagacccgtctccaaatcccggcatgtgccaaggtcctggggtcaggactccaacacgtgagtttgggggtcgggacatgattcagcccatggccatttgtacgaccagagtgccttcttattttcaggaggaacttttagtgaaagctttgaccctgttgacccatgtgcaacggctgggcgatgggtcaaccgtgcaatgactgggtgatgggtcaacggtagagtgactagaagatgggtcaactgtgcagtgactgggcgatgggtcaagtgtgcaatggctggacgatgggtcaactgtagagtgactgggcgatgggtcaactgtagagtgactagaagatgggtcaactgtagagtgactagaagatgggtcaactgtgcagtgactgggcgatgggtcaactgtagagtgactagaagatgggtcaactgtagagtgactagaagatgggtcaactgtagagtgactagaagatgggtcaactgtagagtgactgggcgatgggtcaactgtagagtgactgggcgatgggtcaactgtagagtgactagaagatgggtcaactgtagagtgactgggcgatgggtcaactgtagagtgactagaagatgggtcaactgtagagtgactgggcgatgggtcatctgtagagtgactgggcgatgggtcaactgtagagtgactagaagatgggtcacctgtgcagtgactggacgatgggtcaactgtagagtgactagaagatgggtcaactgtagagtgactaggtgatgggtccaccgtgcaatgagtgggcgatgggtcaactgtgcagtgactgggcgatgggtcaactgtagagcgactagaagatgggtca

SEQ ID NO: 109 - DNA, 1516 bp, Equus caballus
gtttccccatgtccggcttgtctgccgcctaaagtgcgttccccttaagcataaggtatgatgtggcaaaagctctatgtatctctcctctctccatcctcatccttccacttctaacccagcacagagttcgctctgaccgtccctatttccaaacctgcagctccctctctgacagctggaaccccacgtctccttcgcccccacatcaccccttacttgccccaacctcgaacaccccctgctcactgcttcgagaacgacgaacccagaactctgcacaaatcccgtcttctaaaccctcgataactttcaagtcaaagcccgaaggactcctgggtcctggagcttttcctccagtcgtcgtgtgcggtttgttgagtgaaacagtgactttgctgcacgggggacggtgtccggcgcccacgatcgtgatgtcctcagacgcacggtcgacactcactctctgctcctcgcacccaccgctggtcacgacctcttgcaaacgcttgaagaaaggcagctatgggcgtgttgttgatcgcaactctgaaggtcattgacccgaaggaacccgtagttctggctgacatgaatattgacacgatttttgagaaaatcttgcttttatgtgtccctttgaagccccatcccgttcccacgtcattttacagattcccaactctgctcagcgttgcctcagtttggcctcgatttctcttttttgacccagaaggaccattacaggttcagatcatcaacttcaacttcaaaaccgtgcaggtgacgtggaacagcagcgggagccccggggtcaacctgactttctcctacaggtgagcaccctctggtgggcgacaccaaggccctgtggtcacacccttcttcttctgagacgtcggccccccaggtggggctggaaagggcggatctgaatgatcagaatgcgcgagtgtgaacaggtggggtgtgttccagcctcagtcctcaccgcaaccccaaatcttgtcacctgaggatgactgagtcatgctcgaaaccgcctagattctcggcccgatattcgcggaagtcctttctcacccccggggccccgtgtgcaaggtctcggtgtcaatcttttgaacccaggtcaccaggggtgacccggttggcctcatttgggctggtcaggagtcgcctttaaaaccctcagagtccttgagtccaaaacgtggcaaggaaggggttttcccagtgagtttcatctcgggttctgagaaacggaagtgggggaatgggtgggttgagttggatcgaacacgaggatacacaagaaaaaacccagaaaacggaaactcgacatgtcgatccgctttaaatttattccccttaaataagcgcctcatttactctacagataacattggcggactctgggaggcggcaggggggtcaccacaaatcaaagagacgaccagggcaggggcagccctaaaaaaagagaagtgaatacacaacctccctccgtccttct

SEQ ID NO: 110 - DNA, 1987 bp, Equus caballus
cgtctcctctgggaagctccggtcggttcttttggcgccttcaactgattaggtgaggcccaccctcgtggcagagcgactcaaagccaacgggtcataaaagcgaatcgcgtccacctgtcagcttcacagccaccgtccagactggcatccagcagaggagatgccggaagaattggacaaagtcgacacgtaaaactcaccattgggcaaagttcccggggggcgatgacgccctgcacacactgcccgcttttctttcacggcctttagatacgtggggacactccctggctccgagtcagtgagcacggtctacggaatcaattaaaatggtgtggcggtcagtgagccagggctcagagccgtctcccaatccttcgaggcctgccgtgtaaaccgaggatgaggctgcccctccctggaaaggcccaaggaaagtctaaaaagtcggcttggaggagtcgtccaataaactctgggtcgtctgtgtagtaaaagagtgaagagccacccgaaggcgttttttaaaatttttttggcttttgaagaaaattagtttattgaggccataagggcttataacattgtgtcatttcaggggtgtgtttttatattggactttctgtgtagaccgcctggagttcaccaactacatatatatatatgtatatatgtacaatggaatactactcagccctgaaaaaggatgaaatcgtcccattcatatatatatatatatatatatatatatatatatatatacaccattttctttatccaatcatcaattgattggcacttgggttgcttccacgtcttgaccattgtgaataatgctgccatgaacacagggatgcatgaatctctttaaattattgatttccagttctttggataaaaacccagtcgtgggatagctgagtccattctatttttatttttaattttttttgtattctccatattgttttccacagtggctgcaccactttgcattcattcattcatttttttcaaaaatagtccttagtgatcagaggcagcgggtccagtaaatcatcgtgttgtctgaatcctcttggcggggaaataaaaaatatccgtttcctaatgatgattctattgcagctacaataaggcaggttctcaagctttttcagttggttctcagcctgtctgcctgggtgtctcctaaaatctcgaaattaagcaagcgggacatttatagttgtgacaatcagggctcatttgaagggagcacccggcaccagggaattctttgaaagcatctgtcagggtgtttgttgtaaaggatgcttttctcctccgaggggagaggcgttgccccacccgtttgtgccgcggtcgcttggaggtcgcttggagggcagagagaggaggtcaaatgagagcgtgaatgcggggtctcatgagtcccaggggtgaaggtcaagattgttgatccactcactgacggcggggtctgcttgtcctccaggctgaggagggcagaaactgcaacgtgtcgatcccgggcttggatcccgacaaatgctacttcttccgggcccgagcgaggaccatggaggcggcctacggccccgacacctaccccagcgactggtcggaggtggcccaccagcagaggggccggcggcgaggtaacgcgggtcccggggcagggccggcgccccgtcctccggggagggtggggaccctggggcatgaggacctggcggcctcgtccacacggcagacgaagagcccgccctgcggggtcccctctccaggcggccggccttgtccggggaattttcttctcgacttctgttcacaaagcggggtgagagccaggcccacccgccaacttagcctcaccggtgtagacggaggtctgtctctaaacacctgcgtgtgtggacttccaggtgtctatacctatctacagaaggacagatagatagatagatggatagatggatgg

SEQ ID NO: 111 - DNA, 22330 bp, Equus caballus
cagatgggtggatggacggatggatggatggatggatggatggatggatagatggatggatgggtagatagatggatgattgatagatacataaactatctagatagataaataggtgatagatagattgacagatatgcatatagatacaggtggacctgtagatgatagatatgtattgaaagatggaaaaatgtgtggattaaaaatagccagaaagatgagaaaaatagatgatagatacgtaggtaggatggaggggtagatggatcataggcagacggatgatgaacagacataatgggtagatagaccgacatggatggaggaggaacaaaggggaagaagaatagtttgatttattaaatagcagaatagaaaaacctaccctgtgtatgtgttgcgtgtttcgcgtgtgtgttgcacgtcacgtgttgtgtgttgcgtgtgcccacagagagagagggaggaagcagagacacgcggatccatccaacagcagagggaacatcgtggacccggccgcgctgcccacgtggaaggtggtgactcacggtggacggccgacggaggaacccgggaggagagacaggactgaaggagtcctctcggcggctcacggcctaagtactaagcattggactaacagggaaggcccctaattcccatctgggtgtccgcgaccccgggtgacccggctgccccatcacctccctccctcgactcttctcattctcccactcacccctccaatcccagccacacagcccctttgctagtcctggcaccagccccgcatgttcctgcctcaggacctttgcatgggctgtggtcccacctggaggcctttgcctggttctctgcctggttcacccttctcctcctgactcccacgtttaatcggaactttttccacctcccagcgagcatgctgggtcccgctgactctacgccacttatgtattttttatttttttattattttattgaggtcataatggtttataactgtgtaatttcaggggtatgttattatatgtctgtttctgtgtagatggcgtcgtgctcaccaccaatactctaattttttttccatcaccagacatatgtgcccttaatcccttaggaccgcccccaacccccttcccgtctggtcaccactcatctgtcctgtttgtccgtgtgtctgtttatcttccacatacgagtgaaatcgtacagtgattgtctttctctgtctgacttacttcacttaacatcaggcctgcaaggtccattcatgttgtagtgaatgggatgattttatcctttttcagggctgagtagtattccattgtatatatatctcatatcttctttatccggtcatgggtccatgggcacttgggttgcttccgcgtcttggctgttgtgaataatgctgccgtgaatacgggggtgcataaatctctttaaattattgatttccagttctttgggtaaatacccagtcatgggatggctggatcatacagtatttctatttttaattttttgaggaagctccacctgtttcccgtggtggctgctacactaattatttttttcttcctgacgttgtccgtttgtccgtaatctgggcccttgtcgccccttctccacctctgcttcctccccagaaggcgagctccttatgggcagaaatctgggcctttctgctcagatgagtctaaacgcctagaccttggctcggggtggctgctgattgaatattcgagcctggaggtccccagatgcagcttgaggggctcagacaaaaagctccatctacacaaacaggatacgaaagaaacaccgtcgagatgaccgttagggaggatcagatccacgtgacagttttgaggcggccaatagttgatcgactttctgagcgaaacagagtccccagaaagttgtgcaaaaggtttttttttttgcactattttttttttctgagcagaaagtgaccacggaaaccaaaatggcaaattgccgtatggggacggcccggtggctcagcgggtacacgtgcacattccactttgggggcccggagttccctggttcggatcccgggtgtggacatggacccgcttggcaagccatgctgtggtaggcgtcccacatagaaagtagaggaagatgggcacggatgtttgctcagggccagtcttcctcagccaaaaaaaaaaaaaaaaaaaaaaggaggattagcaggtgatgttagctcagggccaatcttcctcagaacaaaacaaaacaaaattccagtggtgtggagcaagattttattaaaggcgcgcgaggaaggaggagggcggtgggtgggggggacagaaaccaggcctggtcgtccccccgacccctccaccccctgccccgcagtaattaggacatcacggcttctccgccggggaaaaggtgcaaattcgtctcttcttccccaaagacgcatccgggaggggccgcagcccccccccccgcccgccaggtgtgtccgcgggcccctccgtcggccgtcgcggaccctcctctgcggcccccctcgggccctaatgagctccagccccacccggggaccccgggacccccagaccttccgcgtctccacccccccgcctcccacaaccccgtttgcatggaaccgagtgggctgcagaaccgcagcgcgcggggtcggggctccgaaaccgtggggggggaccctcctggggtcgcggggtcacctccctccccaaactggggggcagacacctggctgcgcccccggacctcccccccgtctcctgccattaacgctccccccccccgggggcgtctattaacggggttgaatccggaggcggggcgcgtctacgcggcccaggtggacgccgtccgctccggtttctcctcctcggcggccccgggacgtgacccctctttgggaaatgctgatttgggggattttttttttttttttttttttttttgcaggcgcgtctgccccacatacaattttctctgacacgaagaataggctgggaaccaaataccttttttttatttttttcctcttttttttttttccgcttttttttttttttgcaaagtgcgcttaatgagatccagtccttgcagacgagcgaacacctctttggggagagggcacatgcggggcggccccgggggtggggggcagatgcctctgccgtttgcactcaaattacccaaaattacccggcgtgcaccgcgtgtaaggggtcgttcttggctttcctcggtgggacagagatttaaaaatctccaacacccccatccgcccggggctgaggggcgtctcgggggacaacaacttccagggccccaagtggggagtcccgggtccccccgagtgtcaggggacggcaggtcccccgggtgctcgaggcgtgtgaaaccccggccacatctgcctttcccaaagcggctttgttttgtttgtctgggtttggctgtttttgtaaaaataggctttatctgggttgagctgttttagatttatgaaaacaccgaggggaaagtagaggaagttcccacgtagcccgtcaagcacgcccccctgcacgcggtgcgccctgggattaacgctgtgcgtgcgtgcgaaaccttgttgcaacgaggggtgcgatgcattatggcgttgagcgtgcaaaacgttgttgcaacgacggctgccgtgcattgttgcagtgatggcgagatgcattgttgcaacatgggagggacacattgctgcaaggtcatgaaggaaacattgttgccgtgatgagaggcaggcatcatcctattgatgagtgcggccgattgcaatgacgggtgtgacacattgttgccacgatgggagagagacattgttgcaatgacgggagggtcacatttgctgcaatgatgagagggacacattatcctattgatgagtgtggccagttgcaatggcgggtgtggtacattgttgcaatgatggatacaagacattgttgcaacaataggtgagacgcattattgcaatgatgggtgtgacattgtcagcaccatggagggaaacactgttgcaatgatgagagggacacattgctgcaaaggtggaagggacgcattatcctattgatgagtgcggccaattgcaatgacgggtgtgacacgttgttgcaatcatggatacaagacattgttgcaacaataggtgagatgcactgttgcaacatgggagggaaaccctgttgcaatgatgagactgacaccttgttgcaacgtcatgaaggaaagttgttgccacgatgagctgatctggacacacgttattaagcaaagtccacggtctccatgagcgttcatctcgctgtcggacactttatgggtttagacaaatggataatgccgcatacccaccattattttattgtgtagagtagtttcgctgccctaaaaatcccctttcctccacctatttatccccctctccccgaagcccccagcaaccacgggtcgtttcaccgtctcccaaagtttttatttttatttcttgagaatcattgatttttttttttaatcgtcatgaaatccgcatcccgcgtaattcaccattttaaagcacacagtgtgcattgtgcacgcccacagcggtgcaaccaacacctctgtctggtttcagaacgttctcgtgaccccgagcggtaacgttgggcccacgagcaggccccaccgccctcctccggcccctggcaccgatcatctgcttcagaattgaccgaaaaatggctcgtcagggcggccagaagcgaattctcccagttgagagcctggtctaaatttcagagggattctcatcggtttagtgtcaatcagcaaacacacgtggagcagaaacgtgaccccatctgtttggccgtctctcttcagacttcgaggcaggtgtccgcccggctgtgggtctggcggctccttggggtgttggaggaggtgatgggggaggaaaagagaaaatcatttctgttctggccactttctcccccggagtctccccgtcagcagaatttcttatttcggtggcagttttccaggatgatggagacagcacgacactccctgatggccaggtcctcccgccaaaaaaacacaaaaatcatccacaaaagtccgactgtaaagaatgtcccctggggggatgccgccatctttttttttatatcgagtaatttgccttttttttttttggtgaggaagattagccctgagctaacatctgcggccaattctcctcttttctttgctgaggaagactggccctgggtgtgggaggaaggaaggtgcgtggatggactgaagggtggcctcccaaaaacatacgctgagtcgtgaccccaggacctcagaatgggccttatttggaaatggggtctttgcaggtgtgatgaagggaaggatggagaggagggcttcctggaggaggcggccctgaatcaaggatggagaggagggcttcctggaggaggcggccctgaatcaaggatggagaggagggcttcctggaggaggtggccctgaatcaaggatggagaggagggcttcctggaggaggcggccctgaatccaaggacagcgtcatcatcagagacagaagaggagacgcagacgcagaggagcagccccgtgaggatggaggcagagacgggagggaggcggccaccagcccagggaccctgaagccccggacgctggaagaggcaggagggaccctccccgggagcctccggagggagtgtggccctgtgacccttgacctcagactcctggactctgtcaaggtgtcgaggggaatgagccaaacatcccacaggagcagggtccaatcgatgattcagttcagaaaatgagaagaaggaggtggggagagacagagttttcacgtgtagacaagctggggtgtagacctgcttctggtctcccacatccttgttcttggttgcatagtattccacgaacaaaccacaaagtttctggtctcctgtatccttgttcttggctgcatagtattccacaaacaaatcagaaaatgtagtccagtcctctgtgggtggacacgaagctcctcctgaattttcagcatggccaccggggtgccctcgacaccctcgtcccccagaggtgtggacgtgtgtccctgcagacgagcacctgcagagggaggagcggggaggtggctgcgtcaaacagcaaagtggatttgtcctccggggaaaagctgtgcccgttgacacccaggtccacaccgcggtggaggtcaagttccccgagccctggggccccgcccgtcctcaggctgcaccgtccccgccggtccgagaagcacaaagcggtccctccacttggggacgatggtctaaaaccgtattttcccgactttgagcttctcggtcacggttttcacaaacacgtgtgcttctttttctcaaaactgttctcgccttttgtggcttttttttgacacgatttttttctccccgaaaatgtaggaattctttgtgtgcgaagaaaattaaccctttctatgtacgtcttgcaaatcctcttcccgcagggccgacagccttttcatcgtgtgatggagggttgttttttacacagaagcattaaagttttacaaagcaaaacgtaccagtgtttccgcttacggctgctgtgccgtcttgggagagcctcgaaccgttcattttatgatacaaaattactaaatacttgtacatattgacatacgtaagttctcttacatatttgtatcatttatgatacaaatttactgaatgcttatacatcgtgacataggtaagttgtcacacatatttgtaccatttatgatacaaaattattaaattcttatacatatttatggatggaagttctcctacgtatttgtatcacttatgatacaaaattactaaattcttgcgcatattcacacatgtaagttctcatatgtatttgtaccatttagatacaaaattactaaatttttgcacatatttacctatgtagattctcttacatgatacgaatttactaaattcttatgcatatttacataggtaagttgtcacacatatttgtaccatttatgatacaaaattgctaaattcttgtacatattcacacatgtaagttcgcgtacatatttgtaccatttagatacaaaattactaaattcttacacatattcacatatgtaagttcgcgtacatatttgtaccattaatgatacaaaattactaaattcttgcgcatatttgcatacgtaaattctcttacatgatacgaatttactaaatccttatacatatttacatgggtacgttgtcagacatatttgtatcatttagatacaaaattgctaaattcttatacatagtgacataggtaagttgtcacacatatttgtaccacttatgttacaaaattgctaaattcttgtccatattcgcatacgtaagttctcatacatatttgcaccatttatgatacaaaattactaagttcttatccatgtttacgtgtgcaaattctcatacatatttgtaccacttacgatacaaaaattgctaaattctgtacactgtgtctacgtagcatccagaataaattctacccgttcttacaccgaattcttgtggatatttacctgtggaaattctcgtatgtatttgtatcattgacgagacaaaatttctaaattctttttttttttctgccctccgtctacccaatctatctcacaaattctcgcgcatattctcacactcaattacgacacatacattctgtgttttcgtagccacgtcctggctctttgtttgtgtccctaacctgtgggtccgtcgtgcgagttttcctctttcctcggccgcgtttgcaaaagtacgatttctcgcacgacctctagattccctgtttctgcctcagaaattaactttactgcagatacggaatttctgacttattttaggaaaactaggtcttgcattttttttttttttacccgggaagggggtatgtttttcgtttcattgcatctggctttccgtgcacctttctcgcgtctgtgaattggggacgcccggggggtcagcaggtcacggcgcctcagggggtcccaggggtgtccgcgtcagagcccccagtgaccccgtgacccgggcaggcccccaccctcccctcgtctccccggggcccagagccacgggtttgcacaacctccaaccacactcgacgcacgcgcgaggcggccgaaatcaatgcaaaaaatcagctggcgttgccttgagaggtgttggtaaaataaaaaacatccgcaaagacccccccaaaccatcctcattttcatgctcgtggtaccccaagctctcgactccgacgattgctgaaagtcagaaaaaacagcgtcgtctaaatgctatttgcatgcacagcatctttctttttagggcccagaagacctgggatgggcccgtcccgtttcatcacacttgtggtttttttttttttttatggttttaataataaaatggagaaactccatgagaattagtaggaatcaaccccagagggagagtttcgtgcaaaacttgaacgtacgtatctgttctcgttattatatgacatcgcgtatacgggggacgatcattgaaaaggaattcctcttttttttttttccttctcctcaatgtctagccgcatcgtttgtggacgaagacatcgccgcctgcagatcgcaaatgttaattttgtcaccgaagcgttccttaattcttagcatcctgggtccgcttgccggggaaagatggaaacaaatgggttgcaggaggagccgcaatatttttagcggctgtaaagtgaatgcgcaacagctgtgtcacggatacagcgtagcaaattcgggggaagaagaattagggctggtgaaaggcataccatgtagcaaatttggcagaagaggaaaaggggctgatgaaatggatacaaggtaacaaatttggcagcaagggaacaagggctggtggaaggatacaatgtagcaaatttggcggaagagggaaaagagctggtgaaacagatacaatgtaacaaatttgtcacaaagggggaaaaagaggtggtgaaatggatacaatgcagcacagttggcagaagaggaataagggctgtggaaatggatacaatgcaacaaatttggcattgaaaggggcaaaaggatacaatgtagcaaaattggcagaagaggaattagggctgggaaaagggatacaacgtgaccgatttggcagcaggggatcaagggctgatgaaatggatacaatgtaagaaatttggcagaaagaggaaaaaagggctgctgaaatggatacaatgcaacaaatttggccgaagtggaattagggctggggaaatggatacaatgtaacaaatctggcagacgatttgaggcggtgaaaggcatacaatgtaacaaacctgacagaaataaaagggggaaaaggatacaatgtagcaaaattggcagcaggggaaccggggctggtggaaaaaaaacggatacaatgtaaccaattgggccgaagtggaattaggacggggcacgatatggaaacaaggtgtccgggggtcaaagccgagaagcccagcccgcccggccggcccccagctccccagcctggtctccccccaccctggggtcgctgacctctaatcagagcgccccccccccaccccgccgcccgcccgtcccacccttgggcagccgccgaggacctgattatctctgggttcccggggatccgccaggccgggccttccactcccgataatgttttctgacacatttcaggagccgcggctgacgggcgaggcgtgatgcgcgcgcggggccgaggagccgggcagacggaccacccgagaccctcgggccggggagccgccgcgccaaggaaagccgtttccatggcaacgtgcccctcagctgtcgggagaccaggaaaagtagttttatgattatttccaaggaagttttttttttttttccctttggcctttctgtttcccgaaaacggtgagcgtttttttgttttttgtttttgtttttttttgtgtggattcgtctgtaaacggactcgacgtgcgtggatgaacatgtatgaacccgggaaggccggccagggttgagcgggacgccgggattggggacaacaggggatgtgggccttgaacacgggagtccacacaacgtgatgctgtaagatgtggatttgccccgctgcgtggaccgagggatctctgcgggcgtctcgtgtccaggggtcctcagctccccgccccgtgtctggtgtcccacaaatctgcagaaacgggcaccaaacgcatcctggtccaaattggggacccgagatcacgccatgcagcccttcacggcctctctctttcctgagcagtctgctctctgggaggaaaaaaaaaaaaaaacggcgtgtgacacgagtgtgaaactcattagcgaggccgcgcacccggcacggagacgggctgacaggtgacgccgaggctgcatttttttctgttccaccagcgctgagcgtcccggcggcgtcgacacgttgggaccggactcgagacgtttcgacagtgatggttcgtccgccaaccgccgaaatgggggtcgagagggagacggctcccgggtgcccatggggtcgggtggtctgggggccccggattcctcagagacgggctgaggttctctctgcggagggaacaatgttgccaacatcccacgcctgcttcttcttcaaaacgctggccgttgcgtttttgcagaagatttaaatagttaaatgacgaccccggctgaagcgccaggcttcacgccatgctgtggcaggcgtcccacagataaagcagaggaagatgggcccggatgtgcgctcagggccagtcttccttagcaaaaaaaaaaaggaaaagaaaaagaagaggattggcagcagttagctcagggctaatcttcttcaacaaaagaaagatgcgttttgcaaaagctgaactggccaacgcagaatgtggtgagatcaaggtggggaaactgaggccgagattaagttggtccgttttcttccaggagagtgacctggatgctcccaaattgaaaacctgcgatttttttcggggaggggggctccccaccgagccccggccggcccgtcaccaccccggccccgtctgagttggtcctgtgacactgatgactgagtgaggacgagttaatcgccccccagccgtgaagggtgttgtgccctgtaaatcacgccatggaaaatagtcaggaagagttaaatgtgccgtcagtggtggggcagggccattaaaactcaaaacgctgcaggcggtgggggtgcccggacttttctcctcgtctgacagggacgcggctcaattccctgcggggcagacggtgagcgacccccgggcgacgctgccattttaattgatgggtgaggctctggcggacgtgagggaacaaggccaggttttgctcggtggggtgctggggtccctgcctgggatttgtctgttttcctaaattcaaaggcggaaatgaaggcggcacagcgggtcgctcctttcctgaggaagattggccctgagctaacatctgctgccaatcctcctttttttttttttgctgaggaagattggccctgagctaacatctgctgccaattctcctcttttttttttttcttttttgctgaggaagtctggccctgtgctaacatccatgcccatcttcctctactttatatgtgggatgcctaccacagcatggcttgacaagcggtgccacgtccacacccgggattcgaacccgcgaaccccaggccgccaaagcggaacgtgcaaacttaactagtgaaacacccagccggcccctgactatggtttttaagggatgtccgtcggcagccgagtggcatgtggggcacctggggggggggatccagggcagccgtggggcccccagggttctcaaagctctttgggtcttttccgaggggcctgaccctaagaaggggcggctctgttttttaatttctgcaaaaggtggttctctgattcccgcgcccattttcctgggaacacggggtctgaaattttaagtgctgcccgtgtatggatggacattatacccagattttgtggggttttttaaaaaaaaatcctaattataagtgttaggcacccccaccccgcccaatccccgtggagtcgaggccggatgctaaactgactctctgacggtcctttgagtctgtgggtgaaacccacgggaagcaccgtttctctttgaaaacggggagagaaccgagctgtcacggggttggaaaaagtcgcagaaatttcttggagtaaattcctaaaaatctcagggttgagggacagctacgtggagtcgatgaaaaaaacagcatttttcctgacgttcgttcagcgtgtcttttaggatttgtacttattttctggctgaggggcaaaagtgggcgcacgtgatccacacggggcgttgtgtgcggtgggggggggggtttgtgcaaataggatcaagatgcacttggtcgtctgtgcacttaaaacgctgatcgtttccttattatcgcctgagtcgttgataattcctgtctgtttcaatcgtgatactcaattctcgtgaatttatccttaaataagggtgtttctggggccggcccggggttcgaagtttcggatcccgggtgtggacatggcaccacttgtcatgccatgctgtggtaggcgtcccacatataaagtagaggaagatgggcatggatgttagctcagggccagtcttcctcagcaaaaaataaaataggcggaggattggcagcagatgttagctcaaggccagtcttcctcagcaaaaaaaaaaaaaaaaaaaaaagaagaggattggcagcagatgttagctcagggccagtcttcctcaacaaaaaaataataataaatgacaaaacagcaagaagaaacaatgaactaagaaaaacactaaaagcaacaatgtatcaaaagtatccaactagtagggataaaaatattggtgcttcactggaaaaattaatgggggtctcgtctccacagctgagaaatctgaagcgatgaatagaaatgatgtccggggatgaattagaagggtgacggggcccctggaaaatttggggtgtcggtcgagggggcctctgaactcggcctcacgcaaatgggttccgaagggaaccaggcccgtgtcaccgagagaaagaaaatgacaaattagggatccgcgcgattttcacctcatttgcaatgtttttgcccagaggtcgtaggccgggcaaatttaactagttttaaggtggccgagtctggagctactgggtttcgatctctctttattttgctgaggaagactggccctaagctggcatccgttcccctcttcctctttttccctctttttttttttttttttttttagtgaagaagactggcactgacctaacattggctgccaatccttctctctttttttgctgaggaagactggccctgtgctaatatccattgccaatcttcctctctcttttttgctgaggaagactggccctgagctaacatccatttccagtcttcctcttttttcttttttttttttttgctgaggaagactggccctgaactaacatcagtacccatcttcctcaactttatatatagggtgcctgccacagcatggcatgacaggcagataagggataaaaatagccttttccaacccaccgtccaccttcaggacctggaagctccctccagcgtccatccgccgatcacagggagccgatcatcatccgccaaacagcacggagctggaaaagcaattcacacttccaaaaatgcacaggatccccgggtcccgggaactcgctgggggcccccaaaggacgagctgacaccggggtgcaggtgggcacagctgagccgggtgaggctccaaaaaaccaattttagctcaaaccctgaaccctgcaggcgcttgtccgggtgcttatccgcgggcagatgttcgaatttctaagggaagccggggctctgagcgtttgcacacgtgctcacctaccagtgtttaaaactttaacaggtcaagacccgcatccgcttcaaacgtggagaagattccaggtgggatgtgctgggcagccgtggggtaaaggctgtgcgtctctgtgcagaaacttacacgaatcggttatttgcctctttgatggccgacgcttggagaatttttcttttatgtggggagttagaagggcttgtaaaatagcccctcaggggccggccccatggctgagtggttgagtttgcgagctctgcttcggcggcccgggatttcgcaggtttgggtcccgggtgtggacatggcaccactcatcaggccatgctgaggacccacaattaaaatatatacaactatgtactggggggctttggggagaaaaataaaaaaaatagaggaagattatcaacagatgttagctcagggccaatcttcctcagcaaaaaaaaaaaaaaaaaaaaagagagagagaagaaaagaaaagaaagataatatcccgtcggattcagcatcccataaggcaaaccatctgatggggtgtggatgtctcggggctcagggagacggtcctgtggcccctgagacccctcagttgccaggatgagaaaacataatcatcctctggaccgaattgcatggtgctctgtctgccgttgggcctgggtcctgggaaggccgccttcggggacccaaaagcatgctcgcgtctccacttttggagcttttgtgggaaaacgccccagaacgggctttagtaagtgcctttttttttcttccggcaaccgctttgtccaggcccacccctgttcgccggcctgggaaagtcacggaagcgcagaagatctggagggtttgattgacgtccgagggctgccagcgtccagaagccctttatggtccccgagcatcgcggggcaaacggtgagcgtttgtgtcacgaaggtgccaactgtcaccgcgcatgtcaccagggcgcgcgggaaccgggtgggaggggacaatcagacccgttatgcgtcgtaacgaggccgcagtgcgtaacccggagcccgggtttgcggcctccggcgatttttgttaaacggggttttaaacgggccggttgcgtcgctccccgggcccgtctcgagctccgggtgctgagcgagcaggcgcctccgtttgcgcttctgtaaagcgagggtggttttgggaccctttggggtcgttccgaggggctgaaaggaggtggggggcgctccgggggtcgtgccccgcacagagcatgcgcacagccggcgccggtactgttacttctgtgggagtaacgcgcacgcacggggttgttgggcgggctgtgagaaaacggggggatcgaggtgggggacgtggggggtctccccaggggacgtcgggatgtggctggagagtgctgtcgccgttggggaggcgggtcctggcatcggagggtggagaccagagaggttgctccactccccacagtgcacaggacggcccagcacagagagtgggccagcccgaaggttaataacgcctttccatgacagactatcgatcatctccacctactgatcgaccgtctacctatcacctatcatacacacccattgatctatctttctatctatcatccaaccgtctggctatctatcaatcaacctatgcatcatctctgtatctatatatctatcatcgtcatctatcaacctgtcacttatttattcatttatcaatcatctaggtagctggctaatcatctattatctatcttctatcatctgtctatctatgcatccacccatccatccatctatccatctatccatccatccatccatccctgtatctatctatctataatcttcattgatccaccttccttcccaaccattcatcaacctgtccgtccaccatcttgctctcagtctctctccatttgtctttgtgactctaaacctgggatgaacgtgcccgtccccacaggacaaggggcaccacgtggacacattcttggtcgccccacttggaagtgagggaacaggcatctagcgggtgtagaccagcgacacagcagacgccccatgacacacagcgcagccgccccaccgcggagtgatctgaccccgaaggtcagccgttccgaggtggagacaccccgtgtggcctgcgggccacttcagcggggccagcggacacgtaaggagcccgttgcgggtctttgtcaggaaaggccgtccgggtggaagggaagagccgctccctgctggtgcggagggaggaagtccaggggggtcctgccccacagctgacgtgcagtgttggcccctccgaggcggttaatccgggtccccacggccgggccccccggggaccccagacttttcaggtcagctggaaaccagagcaacggcaaggaacccggaaacactgttgaatgactaactgttgacttcgtgttggtgcgaccttgcatttctggggtcgtctcctcttgggtgcaatgtgctatcctttcactgtagctacattttgggttcaatttgctacatcccgaccgtgttgcgatcctactgtcagagtgaccgagggtcagtcgatggacgtctcctcttctctacgcgcatcgatgtcgcccgcccaatggcctcctccaagtggttcccaagccaatcgagtgtctcgaaccgtggtctcttcttgaccccagactcaccaagccacccgaattcccaacatttcagacgccggagatgttgcacacgacgcaaaccccaaacgggcaacagctcgcccaccccggacacctccctcatgtggtccgccatcttggtaaatgatgtccattctccttttcctttttgtgcttcattttcaacataaaagggagtcccgttggtcccacctccaggaatcatggcccccgacgtctctgggccaccatcgcgtccaacggggacgtcctcagtcgcatccccgatggacggtgggctccctacctccaccccggctccccttccatctggcagccagagggaggtggtggaagcaccagccagacctcccgccccacgtcccccatggcgcccctcccgccctggaagaccctttgcaggtgtgaccaatggtcagcacgtcacggctgcacagggtgtccactgaccatctcacagttgtgtgtggggtcagaggtccaagtactaggtggggggctgggctgtgtcctccgctcagggcctcccaaggcccaaatccaggggttgagtggagtgggcctctgatgaagacgcggcttgcaggttcatccaggttgttggctgaattcagctcctcggggttgtgggcccggggtgtggacacggccccgcctgtcaagccatgctgtggtggacgtcccatgtataaaggagaggaagatgggcacggatgttagctcagggccagtcttcctcagcaaaaaaaaaaaaaaaaaaaaaaaaagaggaggatgggcagcagatgttagctcagggccaatcttcctcaaaaagaaaaaaagaaaatcacacagggcccttccaggtgaggcaggatgatctcccattttaaggctggaaaccctaaggatgtctgcaaagtcccttttgtcttgggaggagacacgggtgctggcgggggtggggagggtgtggacccctccgcctgtcacggggctggaaaagggtggttttgtggacgggtcgggcgggtggagacgcctggggatccgggtcagccactcaatgccaggaggacgaggacgcggcccgggggggagtgagggggtctcaagacgttgtgggaagtcatctgggcggggccggcctggggggcccggggaccccacacagaggtggggaatgaatgaatgaaagcatgaacgaatgaatgaagtgaatccaggacgcgcccttctccgccacggacgcggcaggaccggagcccaggcctccaaacggccaagcggcttcaagtcctgcgtctgtcctgaccctggacgcgaactcgtgacccttgacctctgcagacgcccgcgcgcgcggcggctgctggggacgccccgctcccttcccccacccctgcgggccccgctcctcggtgcgccccccgccccgtgtgcgcccccttccctgtgggcgaaccccctgtggatctccatcctgggttcgggaccccctcccgggttcgcaccccgtgccccgtgcgtgtcctccggccccgtgtccccgcccccgccccgtgcgcccccctaccccgtgcgtgtctccctgacccatggcccccccaccccgtgcgccccccatcccggtgcacgtccttcttcccggttcgcgtccccctgccccgtgtccccccccgccccgtgcgcccccctaccccgtgcgaccccccatcccgtgcgctgccccctgccccatgcgcaccccctggcccgtgtaccccccgcccggtgcgcacccccttcccccccccatgcgcggtggcgctggcggcaggagtgggggggcgcgagcggcgaggcgggctcctggcgggtgtccagcgggtcgagctcagccctctcgccgcgagctgcgcccgaggccaggaggctgcgcccgcgggtgcagaggccgggctggagcgcgcgcgcccctcccccgtcgcccggggcccctcccccgctctcgggcgcctccgctccccaattagccgagctgcgccccccagatctccgcccctcccgctcgggcccccgggacgccctgttctccgccctcccccggcttccccggcgatgggaccccgcggcgcggggcaggggtcaccccgagacccccacgggcaaccctgggcggtcagcgcgggcgtctcatgagcggggtggggccccctcgtccacaaggccctgacgagtgacaggacccacccgtccgggaaagcgggttcagatgcccgacagtgactgcgggggggcggggggcgcagtgtgcgtgtgttggggggcgaacaggccgtgacccccctaacgaggctgctcagggaccccagggccgcggggggcgtccgcgatgggcacgttgggccccaagcagtattggggggcccccccggcgccccaacgctcccacgcggggacgagctgtctgtccggacggtgcggttggcgcagcaacttgagtctgttccccgcggggcaagttcggctccagggcagcccctggggaggtggcggtttggggctggggaatgggggggggggggcggccatttctgctgcacaaattggccaattaattaatgcctgcctcctagagggtgaaagtgcctttcctggaattttttattttttttttctaaagtcgtcgcagcgggaaggaaggcagtggcgaatggggaaccgtcagccggagcgcagaggccgccccgggggtcccggttccacccgccttccttgggagcgacccccagtggggtggaaaccacccgcttgcgcctttgggggcaggtggacggggccccggagccgccgggggaggctcgtctgcgggcgcgcggagcagacagacagatgcgtcctggtcccaaacgcccggggcgccggccggacggggaagcgaggcagcctcgaacccgggtccagcgaggacagcgccccgggcgccccaggggaggcctgggaccaccccccccatccccgcgggtgccagtcgctttttccagaagcttccggcccggggggcggggggggggctccgtctccccaagaagcgagtgctcgctggctgtgggcgcgagctggactcagttcggtttccgccgccttttgaaaccggagagaaaaaggaagcgatttggagccgggtttggggcgaggggtttgcgaacgtctccgggactcgcgcgtcaaaaaacggggaggccccgggccggggtcgggggcgcgcgcacgggcgggaaggaaatcggacgcccttgggccagaagggagagtggagacgaggagacgcccccaagattaagtcctggggacccgaattaacgcaggaaccggctccctgcgagtgtctaatatgggttcgtggcggagcaggaagagagccgtccatggtcggtgcaaagcggcctccggagaaaagagccccctcgcatgtcctacgtgggcattgtgctttgctccctggaaaaaaaaaaataataataataatgtttttcttaaataaaacataaaggtcccgtgatggaatcgccaaggaaagctttttttttttttttttttttttaatgtccaccatatgttgcaaagtacgtggtgccggcaaaaaaagaaaaaaaaaaaaaaaggagagaaaattccgcagaaagccaacagcattccctcccacgaaatagattgttcaaaatgcatttattttttttgggggggggggcatcgagggctatgttagaatgcccttcacataaatcatgggatttgtagggaaagtgggacgaaatgaaaaaaaaaaaaaaaaaaaaaacccagtttctgggagggcccttggaaccaggggcagccgggcctgccccatcgggccctttattaatattatagatgtcggatttgtcgacaggatgcgtgtcgtccgttcaggggggcggatgaagagaggccccgtgtaatgataacctattagcctcgaatcggaaacacgggtgttggggtcaatcaataaacagcataggataggaggggcatgcaaatgcagctttctaaatggaaaagggggaggaacgtaaaaaaaaaaaaaaaaaaaaacgcaacaaggaggccgtctaggaaaacgcgttaagacgcctataaaaatccagcccctgtgatcgatcgtcataaatatttaatgggtggggagggtttggttgttgtttaaaaggctctggctcttcgggaaaaaccattaacagcccccccccccccagtccttctgattaatagaaattgtctttggaattacggggcccgggctgaaggggcattcctgaaaagatgccccccccacccccgtttcaagggaacccaggaaacccccgccccggggttggggggagccttgagttgacaggtggtgtagacgaggccggggactccggctcctccgggaggcttgcaggccccagaggctgcaaatggtgcccggcaattaagagctgggggcgtgaaatctgatttcagggaaatgcatttgggacccccgcgaggagactcgttgcgctggggctccaagtggaaattccgagccagtccctttttgagggattaaataaagcaaatattaaatatctgaatattcatcgcttccctttccctcggcgttggagagagagagagagagaggcagaccccttagaggcacaggccgttcattaaaatggccctaatgcacagacagaaagtcagattattttgcaaaatgtaaaaaaaaaatcaatgtgcatttcctcgggccagcctaagtcggtccctggggtccgtctcccaccagcctggcctcagaaaaggccggttggcatgtggggcggccggtggccggtgtccgggctcagctgtgtgcacggcctgtgtctctgggtgtcccgggcacccgggctggcccgcaaggcctgggcgtccgagtcgaacgagggcccggagcgcagacgaccgccgagaagtcttcggtctcgtgtgttttctgcagccggggagacggagagaggacagaagacaccccacggccaccggccccacacgaagagtccttcccgctccaccggccccacacgagagtccttcccgctccaccggccccacacgagagtccttcccgctccaccggccccacacgagagtccttcccgctccaccggccccacacgagagtccttcccgctccaccggccccagccagcaggacgtggccccggggggcggctcctgagcggcgtgtccgagcttcgcggcccggcctgggtccccgggaggccggctgaccggaaggagtccagctggggtaatctcggggtgtggggggggggtgcagcatcttggcctggctggccttgggctctctg

SEQ ID NO: 112 - DNA, 65268 bp, Equus caballus
attcttggaaaaggtcccggcagagagagctgtagggtctcgtgctgtgttgtgagcatgtgaggtgcttggggcacgtgatgaggtcctcgtggccaccccaggacctggcagcggctctccacctgggagagcgtcagaatcccccagagggccctgaggacaggtggacggatggatggagggccatgaggatggatggacagatgtgaggcctgttaggacagcctgatgggcgggccctgaggatgggtggatggatggatgtgaaaacagctggctgagccccttccagagtttcagttttggggtctggggtggtgtgtgggatttgcatccctaacgtgttcctggggtctggttggttcctcctgagggcaaatctgttccaggcctcccttccagctttctgtgatttggtgattttataggaacacaaggtcagtgctctaagggctgtgaggtggtctgtgtgcccctgtgtgagggccctgagcccagccatgagcatggaccttctcctggaagcggggggagaactggggacgaggagccgccctcatggactccaagctcccgtggtacaagcctggtcgccgccctgtcctcgctcttcgcctccctggtctgcttccagcgctgcgcctcaggctgtgggaggagaggcctgagcctttcctatgacccacgtgctagtggtccgtgcggcctcaacgctcctgggaggaggagtgaacccctgggttaggccagctgggagggacagtgaggacgtaggtgcgcgcgatgtggggcagtgggcaggagagggaggggcggccctgcaagcttggtgggaggaaggtgtgagggcggtgcgggtgcttgagacctgggcaggggccactggagcagccgccagggagcacaggaccggcctgggccagcccggctgagcggggtgcagggcctcatcgggaggtggggtgtaggggccccgtcaggaggtgatgtttgaaggtcccaggtccactgtggggccatcgtcgcgtcttggtgtgtgtgcaccatgcgtgtttaaggcagtccttcctaactctacaggacatacatgcagcgttgaaattgctggacgctgtcaatttactgttgcagatagtcgactttgctttccagaggctgtatttgcatcggcgtctctgccgtcccttagccttctgtggggagacgctggctgtcggggcccctcatcgggcctgccgccacagggctctgaggcttccccgaggcggacgcctgggccgaggcacttgcctctccagcagccacagacgatggctgcacgtcagccgcctgtcctgctgtggagcacctgcctggtcagggagctcatccggtgcagggtgggcccctgtgtccacgatgtgcagagaccctcagcgcagcccccggtgtcggctgttccacgtccttcagcgacgtcttctgcactgaggagcgggtccgtgccagctgcattcccatctaagtggcagactgtgaggctccccgactttcagggctcggtctgtctttccttcttgcctgggcgggtccatgggtggcgctgccgcacttgtctccccgtcgatgaacctgggctcatttcccgtttcgagctgtctgttaatcctgccgggggccctcgtgagtgagtctgcatgaggacctgcgtttccctttctctcgggtggactcccgaggtggagggtctctgcattccacgcgctttttgggatcctcctgtccagctttacgtaaagcctgctgaggtttcaatagccattgtctcgacccgacccgttcatcctcggaagcagccctgctcctccaggcctccagcaggagcgactctcgttttggagtctgttgtttttctcagcagtgttttctcttcgctgggcagccttcccggagtgtgctgttctgttcgatgctactgtgaatggaattgtcgtcttagttctagaagcactactgatttatctttttagtcttgtatcctgtgaacttgttgacctcacatgttagttctagtagtcaatcagagatgctgaggattttccatatatgggaataaaaactctcttactgcttccctcccggtctgtatgcctggaacttctttttgctttttcttttcttttcttttttttgctgaggaagattggctctgggcgaacgtctgtgcccatcctcctctattttgtatctggaacacctccacagcatggcttgatgaaaaatgcataggtccatacccaggatccaaaccagtgaagcccaggctgctgaagtggaacatgcgaacttaaccactacgccaccaggccagcccctgtaacttctttttcttgcctgagcgctgtggctgggatcgtggacgtgccgagagcagacagcctccctgtgtcccgtcttgggtagagaccatctagtcttcgtcaaggatgatattggttatgagtttttctgtagacgctcttcaccagctcgaggaggttacctgatggtcctaggttgttgagaacacttaacatgaaaagtcacgttccttctaatcttgtggccagtgatgtggcgttttgtgggttggttttgggtgttaaacccgcctcgcttcctcggataaacccacttgatcacagttaatagtctctttcgtgtgctgctgggttctgactgctgacgtctttgtgagacctgtgtgcggtcagggggagatccgcctggtttctcgtgtccatgtctttggctttggggtcgtggtagcgctggcctcgtaaaatgagttgggaatcatgtcccccgctctgttttctgcaggagtgtgtgcaagattgctatcgtttactccttaaggtgccttatgaagtttagcccgggcggtaattctggtctccatccctctgttttatctgcaagtggaggtctcaccttcatttttggaaggtattgtcctgggtgtcgcatcctagaccacagagcaagtctgaacaaatgtcacagacttcctgtcctggtggccggccctgtggcctagtggttaaatttcctcatgctctactttggtggcccggattcatgggcacggatgggctcagggccagtctccctcaagggaaaaaagagaaagattggcaacggatgttagctcagggctaatcttcctcacaaaaacaaacaaaaaaaccttcctgtctgcagacggcatttttgcatcacagtgcaattcagaaatcgtttttggaaggtaaacttggaaactcaggaccagacttcataaagtgcgtcagtccagcaggaagccgtcgcgggcgctgtaatgagtgctcagagccacacaggaatgaggacgtcccctcgctcctcgcataccccagccggccttgcagaccctgtggcctggccgccttgtccttttcaggagccagggagccgggagatgcaaccagagccggggctgcgggccggcctggggtgcctcttcctcccccctggcggttgactgaacacagtgcactctatacgggcctctgagccggtttttgggaatagctgttttattttatttacagtcaattacaggaaataaatcacctcttagttttctggccaacggttggctccgggcttcgagaattacaggacgagcctggagtcgggaggaggtgtcttgtccgtgttgccacccaggaacttacccctgggaaggaggccaggcctcagaggtgcccagcctgggccccgggccctgagccgtgggcgctgtgcacgtgcaggtttttcacaagcgtgttcccagagagccgctgccccccacccctacggcagcaggctccctctgcttctcatgaccgtgtcttctgaccggcccgtggctcgggcgtcgggagcacaggggcctgggctgttcccacacggtcagaaaatcagggatgtgttgtcagtccaggtgctgagggaccacgttcctgagcgagcgctcccacggggtgtggctgtcagagtcgtcacacggtggggctgaagttctccagctggaaagtggcctcacttcggcggccagtccagtcccgcggtttcctccctccccgtcccaagacgctccatgcctactagttcctctctctgtctccctctctcgctcgtaaatgacctttgagagtttgaagaactattaatctttccccgaagtttattgaggaatggacaaattaggaaaaattttctttgtctatttgtattaagatttctggtttgtaacttttttttttgctgaggaagattggccctgagcaaacatctgtttccaatcttcctcttttttttggtgaggaagattatccctgagctaacatctgtgcccaacttcctttttcttttgcttgaggaagattggccctgagctaacatccgtgtccactttcctctgtttcgtatgtgcgacgcctctacctacaaacactgtcggcatggctgctgagtggtctaggtccacacccaggatctgaacctgcaaaccccaggccgctgaaggggagcatgcaaaaccctaaccactgtgccacggggccggcccctagccatgttttagttgaagaagttaggtcagtttttatccagccgtcactactggacttggctcgtatgtcctggcaccagctgcagagtttccaacagaaactggggaagcgggattgcagtggttgtttcacctgacctggcgactccacagtggggacctgaccggtttgctgggtttctgctggttccctgtccacctcctctgctgtgggcgctcactgttgggtgctgcaccgggcagcttgagctgtgccacgtaaccagccacccggattcagagctgagcccgtcctctgagctcgtgaacctgtgctgggcggttctgtgactgcttgtctgccgcccctgggctctcaccctggcccgctggccccgtgcgtcacggcaggggcgctcccggagccatgagggggcactgatgcaccagcaccctccagtcagtgctagcatggggacgcgcggccgccccctcagcccagcccggctctcgggtggcacgtccacactgccgcctcgtgggaccagctgtaaggccaccttgcgggggctgtgggcctgcaggggaggacccgccactttctcaggctgcactgagggcatctcttcccaaaggttcacagggaaggagggaaacagagtgaatgagcaggtgcagcctgtcatacgtggaagcccggcgcccaatgagtgccaggactgtgctggccggggaggcgtggggagccgctgctgccccggggacagccccatcgaggtttgcgccctcagcatagaagtctgctccaccctgggagcccgcgtggtgctgggcggccgtcctgcgtgtggctctgggtctgaacagcttgcaggactcctgcccctgggcccacgcccaccgtgggtcacacggcccctgatcttactgttgcctctcgctgtcgcacgtggcccggtctgtctgtttggagcacttggaggctgacccaggtcctggcggacattggggtagtggggcaggaggatgcaacggggccgagggacggggaaggcagaggaggaacgggagaggggcctgcaggactctgagacatgagtgaggctgtgaggacgatggacgggagacaaaggctccatcctgtgtgaccccacaggggacccgctggaagggatgagctaggggacagtgacgggaccagtgtcccagggggatggatggggacagatggacagacggagcacgggggcttcagggcagtgaaactcctctgcacgacccataacggtggacacacatcattacgtatctgtccaaacccacagaccgtctgacaccaagcctggtgactaccagggtcgtttcctgggcatctttgtcctcaggggccgggacggacaggccacatccacctgtcgggtggccaggagagctgcgggctggggaggcatcgctggggtcctgggacatctcgggggatgcagctcgacccgggtgggcggccgtgtggggcctggtccaggacggggtgtgttctgaagcccagggcctcccgccgcgtggggctgctcggggctgccagggcttattctcgggactcctgtgtttgtgggtttgcttttttctgcagcacaaactccccactgtgcgtggggctgagctctccatgcgcacagggctggcccgctgtccacgtgtgtggctgccgtgccgggcttgcagtggacactcataaacttcggtgggaggagggagggaggatgcccgacggaggagggagaagcagtgacagatgaaacccccttcttgctcccggggtcggggttagaaggtggaagcggagcggggagccagtgatcacactgatctgcaggggagaccgtgccctgtgggccaggacgcagcccaggtggccgggggccaagggccgagggtcagggtgagcgggccccagggggcgtctggagtgcgtgaggcgctgccccctccgtgcagtggggccacccgggccggcttccctctgggcgggaagggggaaggcctgggaggggtgtctggaggccggccagtgccagaggcttgtgtcacagaagacgggggtgtgtggcccgcacacgccagtcctgtgtcctgccacccgcagcagagccgcacgctctctgggcccctctgctccaaaggcctggccggggcgggagggggaccctcagggacgccgtgttcccacccgcctcacatcctccggcattttggttcctatgggtgtgggttggtgcgggccgggccccgcggtcctgccctgctgctgcaggtgcgtccacggtgggttcctcctgagagattctcccagaagccgtctgggcttcaggaggcagcgcctcccccaggctccgtgcccgcagcacccggcgtgggcccaggcagtcgactcagcccccactgcagcctcggcccttcctgcgggagcaggcagaggtgccggggtccgtgtgtccgccggccgcatcctcagtgcacctgctgtctgctgccctgttggcgtttatgtgaccggctcctaccttacggtgtgtgttagcgctacattctgcgttgtggttacattctgccctgtcggtacttcgtgcactgtcgttattttggacgttctggttacttggtactttgtcgtgatgttccacgctgtcgttgggttccatattgttaccttgtacgttgtggtactttctgccctgtcctgacattctaccttgtcgtgtggaaccggcaccaagactgcagaagccagaatactcacccccccacctgagttttgaaaagaaaactttccagtgtcctttgcagcttcagtatgttttctcagcccctaacgagcaggggaagctggggcgggcagacccctttattcccagcgcattttcagggagggaacagctgcttggctgtatctgggcccctttagtcgcgggcgggcgggcaggctttgcttctggggagagcgccacctccccgctgtgcgagcgctggcaggcggcccaagatcggccccagatcggctgtccttgctgacctgtttgtgccctgtgcgtccgcactgagccgcagctggggtccctgcagacgccgccccctgcacggcctcccgcgccctcagcagccgcgcagagagagctgctcggtcagggcgcgccgcctgtccggctgtccgctcccgcctgcacagccgccgcccgcccgcccgcccgcgggaggggtggcccgccacccctcctgcagccatgtgccctcctcagcctgtggaatgcgcgccgcctgggccggcccccacagcgcctggccggcgacgcatggagcgcgctgagcccggccgccccgaccgtcctgccgggcgcagctgccgccccgagcccgcaggccccggccaggcccagccccgagagcaagagcgagagcgaggtgcctggcccgggccccggcggcccacgcgagccgacatgcggctccgcgaactgtcgctgcgccaggaccccgacctgaggcaggagctggcctcgctggcccgcggctgcgacttcgtgctgccctcccgcttcaagaagaggctcaaggccttccagcaggtccaggtctgccgcatgtcacccccaggcccacccgggtccctcctgagtccctccctggtgtggggggggacaggggctgctcgcacccacccgtgcagggtgcgcaggttccacgtgaagtcgctgggagagctcctaagagcgcgcccgttgctggagttttggcggcaggtgccgcggtgcggccagtacgcaagcccccggcgcggggagaggttccagctcgggtgggggcctgaccgtgtggtcccggggggaagcctggcccatggtcacggccgtctccgtgatgacacggccctgtgggacgcctggtcttctcggccacatggtgtttactgggctgtggggatctgcacacatgggccgggcaagtggatggctcggtgctgatagtgagtagttggcgtgtagacaccctctccatggttgtgtgtgctcagaggagtaagacctgctgtgtctacaccttggacgtgttacgagttagtttgagggacccagtcgtttggaagcatcagacagcccgtgatccccagagtctgtctgtgactcgaggggtctccgtgggagatcttgtcctctcctcagctccgggccggtgctgggggcagggccacagggcgtggggccggggctcctgcccctgaacgcctcgcctcttgcagttagacacccgcacgttttatccaggccaggacttaatgtcctgttgtggccaaaaacaatgacatccaatcagaccgggccatctgggggaaaaaaagacctgctttctgctgatattttaatgggagtttttctgggatcatatctcagcttttacacagcttgggaatttttcctgtcttgtgtcttccaacttcggaagttttgtctgcagctggggaaggtgtgagtctgtcccgagattttaaggaaagtgcctgcatttggagacccaggagtggcatctgccccacactggtcctgctttgacaataggaagacaggtgtggggcagttagggtttctcctgacggtccgctgggctgtgtgggagacccggaaatccctccagcctcgcccaggatggtcgtgcctgggggcccagctccccgcagagcccatgcaggaaagtctgcattgctttagggctgctgcttatcaaatgaaaatcactctttgggaatcaaactttatgaattcatttcacgggaagttgtttcccttcacagaaaacatgtctcaaccttgtttctcagccgtgacgatgtgcattgcgtaacgtgagtgctccctgggccgcaggcggtggaccaccgggtctttctcatgggggttgtggggggagcagaaggagagttctcctggctcctttcaccccaggatgttggcgggacgattcgggacacagccttggggggtcagcaaacgtctttgggagaggctgggggtggagggaggggggtggtgcttcagcctgacggccacgccacccgctcagtggccccctggcccggagcagaggaccctggggtgcggctgtgccgtccacagtggagccatccctgctcccgcctcccatgtccacccacctgccctgcccagggattctcgggccttctgggcgccgagcagcgctgactcccggtggtcaccacaggctccctcaggcccaggatgtgctcggctcgccccgctggaaggggtcctgagcgtcccgtaccccgggggtcccatcgcccgctctccacacacaggctcaggcgcagttgacgggcgcctctgccccccacgctcctccactctgtcaccttgctgtgggcccggacacgccgtccagcctccctgcagggtccttcaggtgggcacacagaccccgctgagcgtcattccagaccccagtgtggccaccccctggggacagtcctggactctgagctgacctcccctccctggggtgacagcctggccttccagctctgcccgtcccagatggcaagtgggtcacactctggggtcacaggccaagcaggtcccaggccgagcgggtcacagtgtgggtggggtcacagtaccctgcaggaggggtcatgaatacccgctttgatccacattcccaggaccccggcagccggaagcggcccctctgtccactcagctgtggatgcaggctcccctcacaggccactccagagccacacgcacgcccccatgggagcccgtcctgtggggcaggtgcagagccgagctgacagtcagtgtccaggccggggaccccactcagccgggctcccctgtctgcgtcagtgttggggacccagctctgctccctcctgtgagcgcggccagcccagcagcctccacagtgagcccggcccctcctgtgctggagggagagcctttgcacaaacccgtgtgcagggcctggctcccctgttgctgtctttggctcccctgtgttaaactttgacccctggctcccatctgtcggcgtgcagtgttgttcgcgcgtttagttagcgcacctcctgccagctggcgtggacggtccacgggagccgaggagaaagctcacggcccacgcgggcctcctgttgggcggcagcatctttggggcctgggctcacctggaatccacaggccgcccccctgagctccctggccccgtccagggccccgtgccggcctcgctgctgcatccggtctcagacagggccgcccaggacgctgctgggcttggctgccccggcccagcgtccctgcctggcctgctctcattctgccacctgtgccctgtcctggcccgttggagtcggagggacccatccgatgtcccagcacgtgccctctgacccctctgggacctgaccatccgaggctggtgttgggaggtgtgaccccagagacacagctggacggatttctgctgggctcccccatacctttctgcaggaaaagagatgcctttgctttatcccagggcttggattttggtcgtgggggcaccgctcagccccactgtgtgttctgggaggcccgcgggtgagtctgaggtcccaggagtggggtcgagtcagggagcaggctgccggggccctctacagaaatagctgtccgtgaggcggtgccccttgatcggggctgcagggggcccgcatggggcgggtgggagcccaggcgagaggcttggggacccgagtgccccctggtcggctggttgtcattttttaagaggcctgagccgtactttaggactctcctttcacacacacatgtgtgtgtttttgccacttttgttcatcccagtcatctggccgcgtcccctggaggtcggggcacacgccccacggtccctgcaggacctgctgagacctgttttgcagccgaggaggcggccagcccccaacgggcaccctctgtgttggaaaagaatgtgagagctgcagctgtgctggggccgcatctatttctgtcccggagattaaacttgtaaatctcccgtgtccgcagcaggctgtttgtttctcgttgtccggtcagctccgtcatcgctccggggagctgggcccggcctccctgggggctggacctctgcttttccctgcagcgtctgccgtgtccgtgtggggctcctggggccggtgtcggccagctctgaggcgcgtcgtttcccctggtcgcctggcctgacacggtccctgtctctctctagtactgtccacacctccgcctcctgtgcgcacgtcagtccagccaccccacggcccctcgacccttttccgtcttttgaaatgttcaccctctgcgcccttacgtcttatgtgggtctcttctaaatagacacgattctctttttccttctgatcttcatctttgaactgtgccgtttgtctgtttccacgtgttatgactgttcgtccatcttggtgtattttcgtcccgtcctgtcttgcctcctctttgtcttttcctctcccactttggagtattcccttgcgcctagctgactgctcatcctagaaatggccactactggatttttccaggtgaaaaattaatacctttgccctccagctcaaaacactcagatgggggccggcccggtggcgcagcagttaagtgcgcacattctgcttcggcagcctggggttcaccagttcagatcccgggtgcagacatggcaccacttggcccgccatgctgcggtaggcatcccacatataaagtagaggaagatgggcacggatgttagctcagggccagtcttcctcagcaaaaagaggaggatcggcagatgctcagggctaatcttcctcaagaaaaaaaaccaaaactctcagacacttccattccacgaccccattcattttacactgctgttgttgccttcagagggtttttaaaaagaaataaaatcaccttcttatgatgattcacacagtcagcatgttgagatttgccccccatacgcccctttcctgcatctccgacctgcgtcaggagcacttggcttctgcctgacgcacggtcccccgcacatcctggaccagcgtcttctcttccgttttggtctcaaactgtctccgtgttggtctcgtgtggcagacacctccctggaggtggcgtttgggcgaaagggcagccgctctcctccagctctggccctgcatttctgtcgagaagctggctgcagggctcctgggtcgctcctttggagacggtccccttttctgttccgttccgtctccttgtggcaggttctgaggctctgccgctgtcttgggtgttgtccagtctcgtcgtccggtgtgcagtgtgggtggctccaaggactcctgcttggggttccttgggcctcgggtctcaggatgtgtctccagctctgcagctgcaggctcagcacctgcgtctcctccctcccggagcacgagtccctcccagctgtgctgctctgctctccaacccagaaagcaagtgtgtttcctgttcttctggacgttttatttggggctgtcttaagtctcctcactcttgcatcttcaagcctctccctgtcttgatatgtgaagcgtgtcggctctcattctcaacgacgccagagtccggagccttcgccagcccggctgctccctgcttgccggctctcccccatggtgccttccttccatgtgtgtttgtgcgttttgatcatgaacgcctcactttccttggaacttggggcgttttctgagtcccgagttgaggatggttcccctcagcgcatcttgctgcttccgggcactgctgatctgcggcagcctgacgtcgtcggctggagggtttggggaccaggcacaggatgtacatttggtttgcacacttgactgggagtctgctgtgagctctcgggagcttcgccaccaccccccgcccccagccccttgacgcagcaccagcttccaggcctgtgattgtcctttccttcctggggtcggaggttggtggggatttgttgccagttcattcttctcgctgcaggggccgcccccgggatcccgctcagggggcagcctccgtcgaggatgctggatgtggcctcctgtccccgagctctgcaacactgtgaggcgacggtcacttcacccccttgagtgcactccctgagggcagcgcctgtccagcctctcctggcctcgctgggtgccccttcccagcgtccgtgccctgagagtccttcctcccttgccagtccgtgaggcactcaggaagatgtttgtcaagtgctctccccagcatttccagctgccttcctcagaagggctggtctgggcccctgggtgttgacagggccacagaaagagcacacgtgttagcatttacctctccctgagtcgatgctgcaagcccagcaccagagctgggtcatccagtgttgcgctgtgcctcagggagtgagttggcgggagacgcttggttccccgtgagtgtgagagacatggaaggttccgggctgggagagactcactgtggacagagggaaacagagtcacgtggccaagttctctgaggtagcagctttccaaacaaagcggaaggtgttttcctttcaggggagctctttgggatgtgcgttccatcactgcatattgttgggggcctgctctgtgccaggcactggagggtagctgcaccttctagttggggtgacagaaaagcctgcagagcctgactggggtgacagtacctgtgaaggggcagcaggtgtggtgggatgtgtgttctgtcagggatgacctcgtgacctggggtgaggttcctgtgagggggcggcaggtggggtgggatgtgtgttctgtcagggatgacctcgtgacctggggtgaggttcctgtgagggggcggcaggtggggtgggatgtgtggtgtgtaggatgaccttgtgacctggtgtgatggttactatgagggggcggcaggtggggtgggatgtgtggtctggtctgtcggggatgaccttgtgacctggggtaacggttactatgagggggcggcaggtggggtgggatgtgtggcatgtcagggatgaccttgtgacctggggtgacggttggtgtgaggggacggcaggtgggagtgggctcaggtggggggtgttgtgttgtctgttgatgacatgctagtggcaggtgggatctgatcatggtcttagatgaggtaaggcagtgtttgtggggtgcctgggaacagtaggcacaaaggccctgaggtgggcagtgacaggggcagtcgttgacgcctccacacacccgctgtcccccagggagctgtggtgcagtggttctcaaactcctgacccaggggaccgtcctcctgtaccagcgtgttggtggaagggacgtgtggtgccctcaagggaagccctcctgctggcggcagccagtgtggccatgcggggtgtctgcagagcgctgtcaagagcaccaaagacctgtggttgtgtctttgcccctaagtttgtagctgcctcccttcctccctccctccgtctgccaaattccccccgtccgcatggctctgaccacaggaggccgtctctcactgcgcagcccatgtgggcgccctccctccaccatggtcaagctcctgaggcagtaagctcgctcgtgtccctctgcccgtcccgtgctgccatccagaaggtcatgtctcatggagccacgcgtgtgccctcgaggtgaggcctcagggcccggagcagaggaagacaggagctctgctgtgttccagggtcagaaggacccgggctgctgcatgaggtgagggtttcctggagatcggcaagccgcgcgtccacccccaggaacagacacacgagctgaggcagagacaggccctcgcgtggcaaccctgggcatgggggcctcacgcatgtgcgtgcgcgtgtgtgtgtgtctgcatcgcgaccagcaggcccttccccaccagccccgtctgggagacctgtttggctgtcgggccccatccccttcctgttcctgcccctggagacaagcggaccagcagacggtggggcgtgaagaaggaggaataggtgactgagccgctgccatcgccgtcgtggaaatctctgccccacgtgctcaggaagcgggtagaaaccatcagatgtggttcaccccgtgcggtgtgaatactgcctcctagagcgacccgctcagtctttgcagcttcggaagacgcgtcggtgtgtctccacccgcagaggtttggtgaactcgctgctgacgcacggctttggccccttgcgaggcccacacaggacctggggctccccgtgcccttggcccaggctggcccctctgcccgggtggcccatcagcttccccctcctggactgcggccgggcctgcgtcacgggggcccggtgtccatcctccttggacctggccccccatgtccttgtctgtacctctggcctctcttgttctccgaggcctccccgcccagcagggccgtgggagggtcgatcggccactgtacagacctcagacgttgtccccgtggtgcctgttgttctgaattcgcgagcacagggcacgtgctcagatgtcataaagtagctcccagcgttgccttggaccatctgttagaccagcgagagagtgaagccgactacaaacgtgatctgaaaactcccgcgtggtgacagacggcgcaaagtaaataaaaagacgtggggcctggggacgcagggcaaaactcacaaagcctaagacacgtgccgccctgggaacggtcagaggaggaacagaaatgacggcacagcgtggagcagagaaggggcaggaaagacggtgtccttgccttttagacaaatgaggagatgctccacccggttcagagtacggtgggggtggagcatgatgcccatgtggtgttttggttcccccagatggcggaacctcagtttgacggcgccctctgctgacggggcaggagggaaggcagtgtcggagatgctggtggcccccggagctcctcccgcaggagcacgtggacgagccacactctggcggtgctgaggccatgccatgcgggccgcgtccctgtgctcccgttcagatcagggcctttgtaagcttcttgtgctcgctcacctttaaacaacgcgggacaggtgcccagcccgtggtggggaccgcccaccttcaggactgtggtgtgtgcagacaccagcaccagggacaccaggcccccgaagctccctcaggaggtgcttgcgtgtatcctcgcgcccgggacaggagccacgagcactcgctgctgcggttgctccacaaaggggcctgctggcctcccgccctcccctcacgcgtgctggcggccaggtcactgcgaggtcaccagggcacaaaggccacgttacttccccaggcagagctgccaggaccccagggcacagccttcctcacggatcccagcccggattcacgtctgcgtagactgcggattcatgaggaggtctggtcgccgcgcgtgacttgtgcagatgaagacagacttcctcgtgagtgtccggcgaggttccagagctgtcgcttggcagcccttgggcaggaaatgtccctgtgtctccacaggaggggggacggatagtgggcgtgagcgacacagggcctgacaccacatgtccaggacgccccagtgagcccgccccgctgctctcagggcttcgtgtggtggagtcagcatcacaccgtcgccagctggagtttgcctgtggccatccaggtggaggagggcgcccacggggacgctcggccagccaggggggccagggtgagcctcgtggtggattgctgtgcactgacagacgcaggaagatttgatttaggttctttgtcacgttctgtccattttgtcaaagtccttttctcaggaccggcctgaatattaaccgtgtaatgggtctggcagaagccacggtgacagcaacctcgttttcaggaatcacacctggtcgtaggcgagaggccgagcagtgggtctgcatggaggcgtagcagtgctgtcatccctcttcctcgtcctttcccaggtgaccaggagcgtggccgcctagcgctgaccagcagggaacgacgtccctgtgactgagcaacccaggggtctgtgtcagcccagccgtggactggggagaaggcacatggctgacaacggctccagaacctgcccaggggcagccaccccacagtgtaggtgccctgccctctgcctggagcgccagactcctggtgcctcagtttccccaccgtgaatacgggatgctggtggcacgtcagtcacagattgtcctgaacgcggcagttgagtgagatggcgcatgggaagatgtggtcggtgctcaggaaacaccaacacggtctcgcacaaaggtacaagcgcagcgactgtggccgacagctcagggcattgggctcgcaattcattcggcctcgccggagagaggaaaagagaaagatgggaaaacggaaccaccgccacaggggaagtaaacgtaggcatttaggggcacagcagttaagtttccaggctccacttcggtggcctggggtttgtgggttcggatcccaggcgcagacctggcaccgctcgtgaagtcacgctgaggcggcctccctcatatgaagtagaagaagattggcacagatgttagctcagtaacaatcttcctcacaaaaaatttaaaaaccgaaaaacgaccctcagtctttgttcagaaatcgaggggaaaagttatcttcctgaaagcgaatcctgggcacccccagcaggtctgttgaaccgaaccctctccttccaaggaggcagctctgggtgtggcttcccctcccgcctgtccctgggccacggtgggtgtggttttggcccagtgctgctgtgcagggctgtcacatcaggactcagcgattctgacgctgtaacccaatccccgtggaacaggacatcccgggctgggaggagggggatcagcctgtgtccctgggtgctgactcggcccgagtctcgtgaagggtgggcccgaggtcatcgtccagcctctgctctgaggctcagtccgcagtgtggtcctcgtgcttcccaccgtccatggcagacccgcctcgctcagcacagccggcctgcaataggtgccggaacctcagggccgccctttgcagcctctcctttctgatcgccacgccgtccacacctgcctctcggctctcagcactgaggtgaccctgcgtccaacccctgactgttttatttgccctgttgtgatcactgggctcattgtcgtgcgtctgcaggctctccccatagccccccagtacagcagactcacgacagcaacacctctggacgtgttgctgccgtctgtgggtcacgtcagtggggcaggacaggaagcatttacaagtgactcctcctcctagcgctggagggaaaacagacagggacacagggcgtcccgggacgtgactgagaggatgcaaggccgtcccgagacgtgactgaggggacgcggggccatcccgagaggtgactgagtgggatgtgggccactccgagacgtgaatgagggggatgagggaccgtcccaggatgtgagtgaggggatgcagggccgtcccgagacgtgactgagggggacgagaggccgtcccaagacgtgactgaaggggacatggggccgtcccgagacgtgactgaggggatgcagggccgtcccgagacgtgactgagggggacgagaggccgtcccaagacgtgactgaaggggacatggggccgtcccgagacgtgactgagggggacaaggggccatcccaagacgtgactgaaggggacatggggccgtcccgagacgtgactgaggggatgcagggccgtcccgacacatgactgagggggacgtgggcccctcccgagacgtgagtgagggggacgagggaccgacccgggacatgagtgaggggatgcagggccgtcccgagatgtgactgaggggacgcggggccgtcctgagacgtgactgaaggggatgtggggccatcctgagacgtgactgaaggggatgcggggccgtcctgagacgtgactgaaggggacatggggccatcctgagatgtgactgagggggacgaggggccatcccaagacgtgactgaaggggacatggggccgtcccgagacgtgactgaaggggacatggggccatcctgagacgtgactgagagaacacggggccgtccctgagatggactgatggactgaggaggacgctagccggtcccagaggctgcagctgggttgggaagaggccctcgttgcaggacaagatgtgtaggacacccacaagtttcagtgtggagccgtgttgactgtgtgtcctggtggcaaattggtagtgctgttggtacctggtgttccagcccctggtccctgtggcatgaggcggtggctgcgtgagctgtgctctgtcactcggccttggggagggtggctgacatgtgagtgccccgtggcgcatggacgggacccctccaactgggcgtctgggcctgctggcactgctgttgctctgggtaagaaccacactgtgcccggtcactgggcccgccctgaaccctctgtggcgtttcctcggcctgctgtgttgtgtgtgtgtctcctgcacgctcagggtctgcaggtcctatgtggtcccgtggtgtcccgtgtgcatcgggttccccagaccttgttgacttggggaccctcacagtgcactctcctgaccgtccgcccactcccggccccatcagcccccgtggcctcaggcattgggtttgtgctccttagtccactccttcccaggtaggacgctgggctgttcctgactcttgagactgtggcctcgtgtccccagccatagagaatgcagggtgtggaccggagctgcgtccacgggccggactgtgcctccctgtcactgcccgtcgaggacaaccgggtgcctggtcctcggcggccgtctacgacccggctcccaggagctgtttctggccccagaaggcctctcctgagtcagcgtggagacgctgctgagtcctgctgggcgaccgtgcccgctgtggcgggaacagcgagcctcatggcctcagcctcagaggaggctcagagcctctccccccacggtgctgcagacccggcccggggccgactttcggcagtcattccttaaccgggtccactgaacagcctctttctgcttgggggcattttaaacaactgtgttttatatacagagtccccccttccgcctgtaacgacagccccacagcaggtcagctccctgaatccccgagggcacgtcccgacaccactgtgtcttggaaagtgtgtcaggaggtcaaacttctccgaggtcgttgttgctgaaggtgctggcttcacttggggtggctcagctgccgttccgcattctggcgagcaagaggccgcagggccagatcctttcccggagggccatcccaggtcaggtgacagacgtatgtcccattctccgggaggcacacgtgggaaccagcgactgcaggtgtgggctccaaagagaggccacacctgtcctggctgtgagcgagcaccgttgacggcccgcctggaggaccctgaccccaggaggaccgcggggcagtttccccgcaaggacctgcgccggcctcccgggcagcctgggccgtcagctgtcgctgttgcggggtcacactgaggcagggctgggggaggctcagcagtgtgggtcagtggtacgtgacgctcccttgtggtgtgtgacctttcgggtgtgggtggcctcgtggctggagttggcccccaggatcgtctggcgttctgtgcacattggggttccgcggccccgtgcgctcactttgagaacggtgccgcccctgtctgttacgggttcatgtgaggacggtgtttcccgttcccaagtcctcaccacctgtctcatttctcaggtccagacgaagaaggaggagcccctgccgccagccagcagccagagcatccccaccttctacttcccccgaggccgtccgcaggggacggtgaacgtcgatgccgtcatcgccaagattgagcggacctttgcccagttcccgcacgagagagccaccatggaggacatgggcaaggtggccaaggtgggtgccccgcgggcggcctctgggcagcaccacgttcacgggttggtgcttgtgttctgttttcaggatctgaaacacagtgcagactctgtattaacgtttgtgccgaatattgaagaagacagacgcgcctgtgtgtcgttgccctcccagatggagcagcgttcacctttgcgttttttaagcaactgatcccccgaggtccggcctgggccttcctctgcgccctcccgccccgtgtctctccttgtctagggtgggtgccggtgggcccacagtcccctttgcccttgtgcctccggggtgctttctctctctttcttcgtccccgccctcccctctggaatgtctcttcctgttctggatgctgaccctccgtccacgtgtgttgtgagcaggttctgtcccgcctgctgaacggctcacgtgctcccttttgattgccgtttttagggcttgtcctcttttcttgttggaacagctttattgacatagaactctcgggccacagttcacccatttcaaatgtacaactcagcacaacgcagcgtatgcccggagttgtgcagccgtcaccgtagtcaactggaggacgtttttgtcacccctaaaagaaaccctgtaccctttagctgtcatccccctgccccaccccctgctaatccacttcctgtctctgtaggttcgagtatcctggacatcttatgtaaacagatgcgtaccgtgtgtggctttttgcgtctgccttccttccctcagcacacagccagaccccggcgacacggcgggctcggctccaggcccccacaacaaagtgaatgtcgccataaagcgagtcacacgaattgtttggtttccaagtgcagataaaagttaggtttatgctatgctgtagtctaagtgggtgatagcattgtggctaaagaaaagtgcataccctaattaaaaaataccatattgctaaaaaacgctaaccagcacctgagccttcagcacgtcctcttctctttgctgctggagcgtctggtgaaaaacgcaataaagcgcagtaaagcgaggagcaagaaaggaagtgctttattgcaaaataaagcaaaaatacgcgtgagcctgtgttttcaaggttcgtccgcattggggcatgtcggtgccacgtcctttcagtgtcccgttgtgcatttatctgttcatcaactgatggacgtctgggtcggcccacctttgggctgtggtgcacagggctgctggaacacgcgtgtgcgagtctcggcgtgcgggtgtagggttctctcggatacacgcgcctaggagtggaatcgctgggacacatggcgacaccatgtttaacgctttgaggagccacaagaccgtttcccaaagcagctgccctgttttgcgttcctactggcagcgtgggagggttcccatctcgcacaccctcgccagcacttgttgtcttgctgattgtagacagcgtgtcctatttgtgcatcttctttctagaaatgtttgtttagatcctgtgcgcgttctttaattggatcgtcactttattgtccaattgtaagagttctttatatattctagattcaagtcccttatccaatacttggtgtgcagacattttctcccattctctgagttgttttttctttttttcaattatacgtactcagcacctgaaaaactgagaattgacctgagctctttttaacttttcttttgctgaggaagactggacctgagctaacatctgtgccagtcttcctctattttgtatgtgggctgctgcaacagcatggcttgttgagcggtgtgtgggtctgtgcccgggatctgaacccaccaacactgggccaccgaagcagagtgtgcaaactgaactactgcacccccaggctgaccccttttttcagtttttggtagtcttccatgatgccagaaagtttttgtttgtttgataaagttcattttatctattttttcatttgttgcccgtacttttgttgtcacatccaagaaatcattgccagatgcaaggtcatgaagatttacttttgttttttcctgagagtttctagtttcggcctttacgtctaggtctttgatccattttgagttagcttttgaatatagtgatgcagcggtcaaactccattttttccgtctagaaatccagttgtctcagcaccaagggtgaagagaccgttctttccccatccggcggccctggcccccttgttgaaaatcagttccccgtgaatgtgagggtttggtactggattctgattctagcccttgacccgtccttgtgtctttatgccagtcccaccctgtcttgattactgctgctttgtagtcagttttgaaatggggacgtgtgagtgccccagctttgttccttctcaagcttgttttggctctccgtggacccttgcaactccttatggattttagggtcagcttgtcagtttctgcagagacgccagctggggttctgctgggcccgcgttgaccctgtagatcggtgtggggagcatggccgtcgtactactgtcttctcatccgtgtacacaggacgtctcccacttatttaggtcttagtttctttcgaaaatgtgttgtagttttcaagtataagttttgcacgtcttctgttaaatttgttctgaagcattttattctttttggtgctattataactggaatgcgtctctaaattttattttcggcttgttcattgcaagtgtataaaaatgcagttaattcctgtgtactgatcttgtatcctgcagtcctctgaactcatttattcgttctaatagttttttagtgtatttgttaggattttgtgtgtacgtgatcatgtcacctgcggctagaaatagtttcgcttcttccttcccggtgtggatctgttatttcctcgtcccgcccgactgctctgggaagaacctgcagcgtcgtgtggtgttgatgtccgagagtggagattcttgatcctggccttgggaaaagcatccagtccttcaccgctaagcatgctgtgagcgtgggttttcacagatacccttcatcgggttggggacattcctttccattcctggtttgttgagcgtttttatcaagaaaagatgttggcttggtcggatgcttttcctgtgtctgttgagaggcccgtgtggtttggttctttattctatggatgaggcgcgttacgtgagctggtttttccaatgttaaaccaaccttgcgttctggagcaaattccacttggccatcgtatgtggtcctttttctgcgtggctggatttcactggctggtgttctgtggatggtttttgtgtccgcatccagaagagatactggctggcagttttcctgtgattcctgtgtctggttttggtattagggtaacactggtccaagaggaagatcggaagtgtccccttctcttctgttggagatcgcctttttaaattttgttttataagtatgtaaaaacatacatggttccaaggtcaaaactcacaaaccagatatattctcataagtccagagtctacccctgtctgttcaactgtggtctcttcctcccccataagtaacagttttcataactttggcttatcctttatggttttatttttttaatatgagcaactacatacaaatatacgtctgtgtatgtacacacatatttaatttcttccatttcttggatgagaagtagcaccctgttctacgcttgggtgtgttctctctgaacattatgggtggcgatcactccccattggcgaggtggtcctcgctttgcatgttagtgtgggagcataaaagtgaccccacgagctgaaaccagtgtagcttttctacttctttggcggctttttccgggcacagttgctgtgcgagaaacagtgggtgtgtgctgtgtacagcttggtgagctccagtgggccctgtcaacccgtcagcacagtcagcatgatgagcgtctccactggcccctaaactctgctcgattctcatcctcccgctcccagccccaggctccctgtgggcactattgattagagatttctagaattgtacataaactaaatcattctgcagatactttcattctttctatggtggtaaaattcacataaagttccaccagcattctagccgttttaagatgtacaattcaggggcctttatttcatagaccgtgttgcacaaccattaccactgtctggttccagaacattgacatccccctacaagggaatcccgggctctgtagcagtcactccccattccccacccccagcccctggcaaccatgcgtcccctttctgtctgtggattgggctgttgtggacatttcctatccatgggatcacacagtctgtgtccttctgtgtctggcttctctctctgagcatcatgtgctcaaggtccatccacgttgtagccgtgtcagggcttcactccttttcataggcaagtaatattccactgtacagatggaccacattctgtttatccgctcctccatagatggatgtttgtgttgtttccacctcttggtgattgtaaataagcgtttgaatccctgttttcagttgttttctgtgtgtgtgtgtgtgtgtgtgtgtgtgtgtgtgtgtgtatgcacacacaccgaggagtagaattgccgggttatatggtgattctctctcgcacttatcgaggaaccacccagctgattcccacagcagctgcatcatgttgcattccctccagccgtgtgcgaggattccgggggctccacgtcctcagcacacctggtgaccctcttcaagtttagccttcgtcttggttcaggccgctgtcactatgcagcacagtcaggggcttacaaacaacagacactcattcctctccgttctggaggctggacgtccaagatcaaggtgccagcggatctggtgtctggtgaggacctgtttcctggttcacaggtggcgtctcctcgctgtgtcctcacgtggtggacggggcgagggagctctctggagtctctgttgtaaggacactgatcccgttcatgagtgctccaccctcatgacccaaccacctcccgaagccccacgtcctcgtactatcccactggggcttagggcttccacataagactctggggggacacagacattcaggccgtagcagcttctgacgggtacgtagagagctccttgttgttttaatttgcgtttttctaacgagtgacagtatagcgcatctttccacgtgctcatttgtcagcgtgtatcttctttgaggacatgcctgttcagatcatttgcccatttttaaaatgcggtgttttcttactgttgagttgtgtgtcctttttctgtattccacattcaagccgtttgtctgacctatgggtcgcacgtgtgtccccccagtgtgtggcttgtgttgtcattctcttaaccgtgtctttagaattgcaacagtttttaattttgataacatcgagtttccagattttttcctgtgtcgttcacgcatttgttgcctgtaaggaaatcttggcaaacgcaaggccactgagattttctcccgtgtgttcttctaggagctgctacatttaccttttccttcaataattttgagttggtctttcgcacgtggtgtgaggtgattgtcaagctgcctcttttgcagacgctgctctgtggttccagaaccacttgttgaagagcgtgtcctcccggtggcctgcctgccccttgccccacgtcagttgacggtacgcgtgtgagtccgtttccggactccgctgtctcagcgatgcgtgtgtccggcaccccagcaggggctgtcttcacacagcagcttcatcattggcgcacattcgggaggtcctggtcttccgtcctcctcctccttttctgggagcgccgtgactcttccagcttctctgcattcccacgtgagttttagagtcatccccgcgtccgcagaaagagccgctggctttgggctgggacggctctgagtgtggatgaatttgggggaaccaccatcgcgacaacatcaactcttcccacttaggacacggcatttccctgcctctatccgagtcttccgtttctctccgttccatcccgtggttttcattgtacacgtcgtgttcatctcttatcaatgtgtgagcactcgggcatcaccaagcgtttcctatttctgatgacaccgtaaatagcattgtcttacttcagtttatgagtgttcctcgcaagtatatagaactactactgatgtttacatgttgccttcgtatcttgtgacctaacctcactcacgacgtagattttctcgggtcgatgaagagagtctcgcagacgctcacgtcctcttctaataaaggcaggtcagtggttccgttgcagtctgtctggtatttccctttcctgccttgtcgcacgggcgggacctgtgctgcggtgtcgatggcacaggcctcgcctctcccagccccgggagcgtcgggctgcctccacggggtggggtggggctggcgtaggcgtctccacccgtcccggcagctccgactgcgtctaccatgctgggcgccctttgaacatcgcgacggtgtgttcccgctggtccagcgcttttccgcgtgtgcgcagtgactgacgagcgaatgttgacccacctgcctctggatgagtcccttgtccgcctttcctgtgcctttgggttctgactgctcgtgcctccttagggcttcatacctaggttccgaaccaggtggcctctggttgtctttcctgggatttcggtgtcaggatgatctggcctcacagaatggatccttattaatctcgtttccagaatcattggtttacaattggcgctattttttttacttaaatgtctgcgagaattcacagtgaagccgtttgggattggagttttttctctctgggaaggttctgaactataatttcctctttttttttttaacaggtggaggttgctggcattttcttgcatggcatttgactgcgtgtgtctttctgagtctctgtccaggtcgcctgtgctgaatttgctggcacgcgccgttcgtaagattccacatttcagggcctgtaggggtagctctgtcttgggcacgtgtgtcttctcttcttattccagtcacttcgaccagaagtgttttaatcgtctgctctttcccaagaactaccttctagttttagtgattttatggaattattttctatcaccttgatttcagatcttttctttggtgtttcctctcttctgcttcttttatggctaatttcttctctttccagcttcttaacgaggcagcgttggcccttcagcctttcttcgttgctaacggaagcgttgttaaaattgctgtaaacttccttctaagccgcgtacccgacccacgcattcgtggcttggtttattttcatttcattccttgctggctagattcagatttgcctagtagtttctctttgctccatgaggagtttagaattccgttgttttgattttcaagtttgcggtttcctcagacatcattttgttattgatttctactttgattctggactgggcaggggaaatacactcatttctgtccttttgaatatgctcagacttgcctgagggcgagaggttggtaggtgtccatgtgcacttgaagattcattgggtcttgaatgtcagcttgctgtgtgggttaggtagtgttatcaccacgttgtgtttctgcagattttctgctggttccatcagtgttcgagactagttctgagatcaccactggtgactacatttcctccttgcaacctgttggttctgcttcctgaacactgagaactctgtcctcctcgtgccctgtgaccctctgggagagtgtggtgctgagggacctctgtcctcctcgtgccctgtgaccctctgtggacagtgtgtggggctcagggacctctgtcctcctcgtgccctgtgaccctctgtggagagtgtggtgctgagggtctctgtcctcctcgtgcattcccctttgtcatcacagctctgcccttgtgttctctggtcacctccgtcttcagttccctacttttgggtatcggtcgacccacacgggaacagtgctgtaaaccactgagtaaataaccttctgatgcacactgaacagggacactctccttccctgcactgagtgctcctgtgacctgagtctggctcctctctagctgccagctgttgtcctgcagctcagttctgaccctctgcctgcagccgctgtcacatccctcggtgatggccacgcccatgcactgccccgttcatatgccagacccacgtccaggtttccagctctgccctggccccacctgctgtagattcaggggttccctcgccccctctcggctgcggtcatttgctgtaacagctcacagaactcagggacacagttactttcatgtccggtgcatcatataataaagcacaccttttagggtagacttgagcagacaggtgccaaagcacgcagggcgagttcccgtgcagccgcctctcttccctcagaaatggggtgtgccgccctgccgacatgtggccacgcttgctaacccgcgagctcccagaccccgttgttttaatggcggcttcactctgcaggcaggatgtcatttccccagtgtccagccactccttcccctgaggagggtgtgggcacagagctcccaccttctagtcatgacatggcctttcgggtgaccagccccgtctgggagccaggaagagtcacctcattaggacaagaccctcccatcacccaggaaatgccgaggggtttaggagctgggtgtcaggaaccagcggcaggaaccaaatattagaagaacggatgctcctggcacccctgtctgtgagaggattcaaagcttcacaagctcagtgtcaggaaccaggggcaggggccacacgcatacagttcttattcacacacagaagaatgttgatgaacctcaggtgcattttgctgctggaggaagccaggccccaaaggccgcaggtggcctgattccatttacgtgagcgtctggaagagcaacgccatggggactgaagagagcacgggggctgagggggccgtgcacgtgtagcaggtgtccactggaggggcagtgacggcacggccctcccctgactgtggggcggacgcgggctctggggcccgtctgcacggtgcagagtgcgtctccctgtgtgcctgttagagaaaaccccttaccaagtacaagcgtgttatgtgacgtgtttttccttcgtagcgacagtcttacagtatttaaacaaagttcccttgtgtcttttacgttttggagtgcgtgtttcccattcacttcagaatatgcacagagagtcccgggaggtaattcaggtcaccatcgaagctttaggactgaccttccagcggcctgtgggacgggtgggcttggccctccaggcacaccacaccttccaggagccgttactggaggggcgcccctaccgggaggggcaccaatgtgcacaagccgctgggggtggacgccagagccgtcccccccaagtcctaatctagcgggttttcacccacccacgtgccaccccccggcgtgagacgctgggcattcctggcagccaggtcggcccctccatcaccagcccgtgctctgagcgtctcctggacattcccacgtccgctctccggccagtgtgcctccgtgaggtgcatgcacagctgcgcgcagccagactgttcttcccatcgctgcacctcagtccactgtctggcctgagcatcctcccagcagccccttgtgcccccttcatgccagcaccccacagccatgagtgttccagtttgtccctccagcccggcgcccagacagctggtgtttccatctgggtcattgtgaataaaggccctgcgaacattctcgtcgagtctgctgggcgtcactgttgtttcctcctcagaggacagctcgggctgtgggcgtgcgcagggcccgttctcagtaggtcctgtcagaccatccttgcaggcgccccagtcccctcacctggccacggcctccctgccagcgcccaggacatgcagtcctcccagcaggagcccgtctcacaggcctttctgtcggcccctctttaagctttgcattggcgtctccctccgagcatcaccatctccctcggagcgtcggcagtgggcgcgttccccactccccgtcccctggggtcctttcctctggagcgccctcgacggctgttgctgtgcggtgtttgcctttggcgtgtcgatcggcacttccttacgctcctgcatgtgagtcctgtcagacgcgggcgtcgcagacatcggtccccagccacgtctgtgttgtcctcgtctgggcggcgtcttccgaggaacagtgatgagcggtggagggtgccgctgcccgtcttctccttcggggttgacggggttttgtgtcctgcttgaggcatttctgctgctcccgaatcagggagatcttcccttgcgttttcttccagcaggtttactggtttcccattcgcatttggggccgggagccatcacgcctttgtggtgcgcggggtgaagcagggtgtcccctccgcctgccgcgcctgccgccctcactgaagacgtgcgttccccgctgagtgtgcgcagcctctgtgctgagtagctgaccaagcgtggggtctgtccctcacctctgctccctccccttgtgctcgtggctcccgccctcggacagtctgttctgatgcgaccgtacgggacgtcttcagagtccgtgcgttgccacgagcttcaaaatcggctcatgtttccacagaaactcaccctgctggatcgtgatcgcgttgcgtgaatgtgtttgtcattggggaacaaccgacatttcaacaacgcgcagtcctcctatccaggaacacgggatgtgcctccatctcgagggtcttaatttctcccagcagcgttgctctggagagatcgcacgtgtttttcgtgagatttatttacaggttgattttttttttaaatgcttttgatagatggcgccattaaaaatttcagtttctaacgttttgttggtaggatattgaaatacagttactttctgcatattgtgcctggatccagcaactttgcaaaagtcacttgtggagtctagtattttctgatcttgcagattttctgcacgctgtcccatgtttgtgaatcacgtccgtttttgcctcttcctttccggcctctgtgtctgtgactcgtctctgccctgctgacctggctgggtcccctggctcccccgtcccagctccggggtgggcgggggccttcacatgtcgcccttgctctgatgcgagctgtggggtttccgtgacaccttcccttagaagaaggggttcccgtctgtccttagtgtcctgtctgttgtctgatgatgacctttcattgttgggttcaatttgctaacgtggattttgtgcaggacttcagcatctgtgtccatgagagacgaccggcctgcagtcgcccttgtgtccttgacaggtttccgtatccaggacgtgctggcctcagagcaagacctgggaaacgtcccttttttattcttgccagactttgtatacgatcagcaggatttcttccctaacgtccggaagaattcactggcaaagccttctgggtctgaattggtgggaagttttaagttacgggttcactttctgcaagaagtgtaggcgagagcgttagtcaggtctgttgtccattccccctaagctgccgtgtttattggcataaagttattccagtgtccactccccgtcttttcagtgctgtggatggcggtggccgctggcactgctaacttctgttttctttctttggttcttgaggaattttgcaaagtggtaactaaccgttgaaaatcttttcaaaaagaactgacttttggttttgttgatcttctctactggctgtttgtttgtttttctttcacctctgccctttatggtttttcttccttcttttccttttttgagacagaagcttagatcgatggtttccagccgcctttcccggtacacgtgtttaaagtcactgctgccttccaaagtttgatgtgtaacattttcattactgtcgtttgaagatattttctgatttatagtttatcaatgagatgacctcattcacaagctattgtcaccgtcttttgtctcgctcgtgggacgggaagcaggctgcttgattcccggggtttgggccttgctggctgctgcagctgggacggcgcgtgtgctctgaggaggtggtggggaccccggggagggggtgggggccccgctccggaaccagtttccgtcgccgccagcggaggcatgagcgcacctttgggtttggcaggaacgcggcgccccctcacggtgccagccgggttcagtggggccgtcttcgcggtggggtccctgggccgcgtctggggcgggtcggggggcgaggcgctgacccctgtgccctccccaggcctgcggctgcccgctctactggaaggggccgctcttctgcggggccggcggtgagcgcacgggcgccgtgtccgtccacaagtttgtggccatgtggagaaagtgagtcctgggggccggggcgggggcgcgggggggcggacaccagcgtggggcgcctccctcagcgcgcaacccccgcacgcccggaggccgctggacgcccttgtgttgcagggtcctgcagacctgccacgacgccgctgccaggttcctgcacctgctcgccagccccggctgcccctacctcgtgcaggacgacttcgtgcccttcctgcaggtacgcccgcaccgccgcccgcacacgggccacacagcgccacccgcgcacccctcactccctcacaggcacatccacaccacacaccctcgccctcacaggtgtggccctgtgtctacactgcacacaggttgggagtctggctcccttccctcagggtgcttactcctcccacaaagctgggtcacggaccacggctgcagtgcagtgcgcgtgggggacagtgcagaccttcccctggccgtgacctgagcccgcggagtcatgcagacgaggcagcagggccccgggcgtctccgtgaagcacgtcacagtgttgagaacgttcggctccctgtgctgcgctagttccctttaggaccgtttagtgctgcttctgcagacggggcgactagagcggagtcagctccgtgtccccaggaatgttctgagcgactgaaggaccagaaccatttgggtcaacatggtttacagcttcatatgcttgtagttcttcgtaaactgggatacttcacggggactcacatgtcggtgcttgtgtacctgtgtcgagtgacactggatggtgagagggaccccgaaggctttgtccagacggtcctgtgctctcttggctcgtggacccgctgattcagatcatcgtgcatctgacgggactttgtgcgagctgctgtgcggccgggtgttgctgagcagcggcctctcgctgcaggagcccctgtgggttatgacacagacatgtgttgcgctctgggggcgacagtgggtcccagagcggtgtcttgtccccgtgtgcaggacgtggtgaacacgcaccccggcttagccttcctgaaggaggcctcggagttccactcccgctacatcaccaccgtgagtacccagcccccgctggcgcctgggcccatccccgctgggagcgcgtggagacccagcttcccgggcgctgtggcccttccggtcctgtcttcctcgcccgtgcacacgatgtcagtagttgttgctccgtgggaggtggggcctcattcccaggcaggaggcaccgcgctgtctcatgtgtccacactcagactccagccgagtcaggtgccggggaggggacattccaaagatgcgtgtgttgcgttcacactccccgggcaggaacagttggccttgggccgctcccctgaggatgtcttagcttcaggggaggagatgcgccctttcctggaagcaacgcatgccagcgccggcccccctgggatccgtggatgctcgggcccagccctgccccccacccctgcccatcacagaaccgcctgtggagccaggtctcccgcccactctcctccccgggtcagcctccgccccagctccagaccaaggggcacagctggggccccccacagtctgccctgtgcacccggctgggagcccttgtctgtccctaacacacagagtgcatgtgtgcggagctgcgggtgtgcccgcgtgtgccacagccacctgtcagtgctccacgtcaccccacaggggtccttagggaggaacgacgatggcaattgtgtttcatacccagaacatcgagtgctgaatgtaaacgaggcctcgtgggggtgctcctcacacacactgtcctcactgcacaggggcaggtgaggggacgtcccaggtgaggacaggtgaggggaggtcccaggacgaggacaggtgaggggccgtccctgagtggagcagggctgagcctggcgcacggtgggcctccctgttcaggtcaccgtcgctgtgcagcctgaagtcactgtcatcctgcagtggtgagctcagtgtgaaagtgtcagagccagcttttcctccaggccccacggtggtgtggacttccaggggctcccgtccacggccccgcccggctcaggcatccagctcacgcgcgggcccagccgagggtgcccgatgcagacgactcccagtgggcagccggcagcccctgccagtcctctggggccccctgccccaggacgctggatctcgtcctgacccaaccgtctgacacgtgcacggcgggcgccctctgctggtgacatggggtcctgcagcccaggggggccgagtccctcctgaggtcagacagaagctcacaagcaggaccaggaggggtcacgtgtgggtcatgtctgaggagctgcggcccccagcgtggtggcgctcagctgacagcccccctccacaggtcatccaaaggatcttctacacggtcaacaggtcctggtcagggaggatcacctgcgcggagctccggaggagcacgttcctgcaggtgggcggcccgctggggcaggagctcttcactttcacccacccatccagttaccacccacccacccactcatcaccctccatccatctacccatttaccacctactcacccatctactcatttactctccgccatccagccatccaccacccatccatttaccatccactcacccatccatacgtctaccatctatccatccatccaatatccatccagccacccacccacccacccatccatccatctaggcatgggggtggacgctgacctgcccacgtccagaggccctggctgtgagggcgtttgtgctcaccggctgctctgcgttgctgcgggcagtcaggctgagtttcaggcgaagccctgacgtgggtgccatgcttccagccctcgagccagcctcagcccccctcgcaatgggaggctcctgtagggtgtccccaccccctgtaggaggcccatctcctgtggacactgccctcagcgtcttgcagggtcttttccgctttgttctggcagaacgtggcactcctggaagaggaagccgacatcaaccagctgacggagtatttctcctacgaacacttctacgtcatttactgcaagttctgggagctggacacggaccacgaccttctcatcgactcgcaggacctggcccggcacaacgaccacggtgaggacgcggcctgtgggggcccacgtgctggcaccctgccgtccccggtgtcatcggccacggccgccgccctgggcctcgtggcctgatccgtctcccccctcacctgctcccagcaagagcggcctttcactgcacaacgacacacacggtctatgggacacacagctccctgcagcgtgacacacgtgggacactgggaaatagggacacgcgggactcctgggtcctgcagctgcgcagggtctgggagcccatcgtccctttcgatctaattgttttcctaagaaaccacattcgtgagggtgtctgaattctccggcatctgttttgtctgtggtcaaaggaggcaggagggtcccctggatgccatccgccctgctcactggtgtctctggggctggccttgggacggcctccatcctgccaacactcgtccgtgggcatctgagtgggcatcgggtccctctcagttccagtcctaacttgacctccgtgctgtaaattcggcaggagtggggtccagggtgggctcgtggtgaccgagcactttccaggttggcagtggcctcctgttggtccattgagtccttccatgtgccacgttcaaaacctaaaaggggttcctgcatgagcagcagcaggcagcgtccctatgtcatgtaaaggaacaggcagaggaggtcggagctgaccctgtgccatggagcccgcggaaacgggttccactgatgtctcatgtcttcccatcactgggtttgagggtctgagtgttctttggtgtggacgtgactgggggcctcaaaccccagacattcgctcttcctcatcctggagcccagagtctgaggtcaagggtcgcagggccgcgctcactccggaggctccaggggagggtccctcctgcctcttccagtgtctggggctccagggtccccgggctggtggccgcctccctcccgtctctgcctccgtcctcacggggctgctcctctgcgtcggcgtctcctcttctgtctctgaggaggacgctgtccttggattcagggctgcctcctccaggaagcccacctctccatccttgattcagggccgccccctccaggaagccctcctctccatccttgatttagggccgcctcctccaggaagccctcctctccagccttgattcagggccgcctcctccaggaagccctcctctccagccttgattcagggctgcctcctccaggaagccctcctctccatccttgattcagggccgcctcctccaggaagccctcctctccatccttcccttcatcacagctgcaaagaccctgcttccaaataaggccccattcgcaggttcccggggtcaggatgtggacatatgtttttgggagacacaattcatcctataacccatgtggtcatttcccatcaggggtgacgtccattgaggcagaaagaattgggggatggggcagactttgtcttcatttccccgtcttgggggcattagtgcttgtttggtacaaggtgaactgtgtcccccaaattcacgtgttggagtcctgaccccaggacctcaggatggggctgtgtgtggagacgggtctttaaggaggggatggaggtgaaatgaggtcatgagggcgggtcctgatgcagtaggactgggatcctgatgagaagaggagatgaggacgcagacacgcacagacggacgaccacgtgaggacacggggggaagacacgtccacacgccaaggagagaggcctcaggagggaccagccctgcctgcacctggatctcagacgtccagcctccagaaaagagagaaacgtctactgtttgacccctctggggtcctttgttacggccgctcgagcaaagtcataccgtgcttttcactttcacttcttagtcaagttttagttgaaaagcacttgtctttcatcacgatcagggggagagcgaatagacgtgttctgctctttcccgtccccccgtcctggagccctgggtagcttttccctcctgtggccttgacttgggctcaggccaccaagactggaacgcactaccctgtgcccggggcggggcccgtgcgggagatcggccccgaggctcccgtgcctccccggctcgaggagggtggtgcccgctgtggggtggctgacgcccggctctccctttgcagccatatccaccaagatgatcgagaggatcttctcaggagccgtgacgaggtacgtcacgtccgtccctgctcggtttgtcttctgctgacttgggccacttttccgagtgcgagtccggttctccctcattcgctctcatccgagctcgtcctgtcctgaaaaatgccattgtcacgtgagggcacacgtaagggggcacaggcctgtcagtggtccgtgtcgggtcctggagtcggggcgtctgaggccatgaggcggtgaccaaggacgtagcagccgccccggcccctcctgggtcccagggggcgtcctcggccgtcacgtgatcacggaggcccctcccggcgaggaactgaggctagggctgggccaagcgcagggctcggctcaccagtggggggtggacagggacatcccgctcctgctgctgccccctgacacggtctttgtctctcaatcggcccggacccaggggcagaaaggtacagaaggaggggaagctcagctacgccgactttgtctggttcctgatctctgaggaagacaagaaaaccccgaccaggtgggtgctgggcagcggtgctgtgctccgcctcggggagcgctcggcagccactggtcctccctgagcgagggcacctcctacggtccatgtgggcgagctcagtcccgggcagggtccgcgccgggcaaggtcgtcctgctggggtctgtcccaggcggccaggctgaccgaggcccccctgccccacggcgaccgcagcatcgagtactggttccgctgcatggacctggatggggacggggcgctgtccatgttcgagctggagtacttctacgaggagcagtgccgcaggctggacagcatggccatcgaggccctgcccttcgaggactgcctctgccagatgctggacctggtgaagccccagagcgaaggtaaagcccatgagggggggacgcccgctgcgagggatggacagcccagtgtgagggggatgtcccccgtgtgagggggcgccccagtgtgaaatgggacaactgtgagatgtgacgtccctgtgtgagggggacgccccgtgtgagatgagatgagacgactcctgtgagaagtggcatcctgtgtgaggtggcatcccagtgtgaggggacgccccgtgtgaaatgaaacaactgtgagaagtgacgtccccgtgtgagatgagacaactgacagacatgacgtccccgtgtgagaggctgccccagtgtgagatgtgacagcccttatgggacgcgatgtctctgcgtgaggtgccgctcacttggaatggccatccccacggtgagttggggacaagggtgagcagggccttggggacagccggtaccgaccacgtgccactggagacagtgtccagggcagggcgggtgtgtcctcctgtgtgacatcagcaccctcgtccagtcgccggtcgctaagtgtggacagaatgccgggcatgtctggcctctcccctcatccccctcagtttttgaggaccccctcagccctcacctgtgagaggggccctgttctgtggggtgagcgtccgtatcccccagggtcaggaaggtgagtgtccccacgcccacgtccctctgcccgtgctctgtgacttgtcactttggggagacctagcccagcacccgtgctgtggggcggtgccgagggtcacctgccccttctgtcccctggtccccagccagctcgagccccgggcctgtgccctccctgctcccggggccgggacccctgggggcgtgtgtggtccaccggggagccaggggacccagcagagccccccaaccctcctcacctgagaaggctgcgtctaaggggaggcccacagcgggacccaggacagcttccgaggtcacagggacgcctcacctacggctgtgtttccagggcttggggtcctggctcagggattgtgactgagaatcgtcctggggccgcggcggctcagtgacgggtgcgcggcgccccctggcggccagagtttccagccttgcttgtgctctgcagccaccgcgccccccaatcccgtccaggcctccacccacgcccggccccccctcctctgtccgctgctcacaggcgtcaagctgtgtcaggaaacgtggtgtcgcgctgtgtttcaaggtgttttcacgcgcacacacacaggcctgcgacggcgcgcccaggggtgattccctgttcaaacgcttcgtctccccgcagggaaaatcaccctccacgacctcaagaagtgcaagctcgccaacgtcttcttcgacacgttcttcaacatcgagaagtacctcgaccacgagcagaaagagcaggtctccctgctccgggtgagcggggcgggcagcacgggggcgggagggccggcctccagccgcgtcctcgccgagtgacacgcgcgtgtcctccaggagagcgagagcgaaggccccgagctctcagactgggagaagtacgctgccgaggagtacgacatcctggtggccgaggaggccgcgggggagccgtgggaggacgggtgagtgtggggacgcggggcccagggatggccggtgggcagcgggcgcctccttcctgtgtccagtggactcaaagcccctcggaaagggcccaggccacagacagctgccccgcttcccgggggcgcctgtgacactcgggtgacgagtgtgtgggatgcgagaaagggccgcgaagacggtgctgggcgtcctgagcgcacgaggcgactctcaggctcttagaggaacctcacgtccgcccgaagccacagcccgagccttcgcatctgtgccgggtggacacgcggcggcccgtggcctgttacccgcacacgcggccccacaggaggcctggaggcccaccgggcttccctcggggtcgtgggccatggagcgcagcgtgcagggcctcagtcctgagtccaggccccggggcggcagcgcagccgggcctggtttgtgttctgctgctgctgcgtctgcaccttccccgagcgccggcctgcagggcccgagcaggtggtgccaggacggggtgcgggggtccccagggctggcggcccagagccggccgtctcctcgaccccctgtgcagaccctgcacccccacgggcccaggcccctctgctcccacgcactctggcccgaccctcggtctccaccgggagcccgggcagttttcctcctgagtcgctccctgtccccagcaccgcggagggcctggcggtgtcccggacggtggggcggggacccagcaaggggctcggggggccacagacaccagagggccaggatcctggacgttgggaacggggcccgagggccctcatggagtcactccccctggggacgtggttgtggtttggtttctgcgtgtcaggccgacgacggggcagaccggcatctggcgcatttccgtctccccccgcggctggcgtgggcccgacaggcgggcagggtcaggctctgccctgaggggctcaaccagacgcacacgcgtgttcccatcgcccacgccccctcaggcctgctcggtgccagggtcaggcgtgttcccacgtgtgcttggagccaccacccgcctcagggggcggcgtcccaggggtgacagccgcgctgctggctcgggggtcctcagaccccacgccccgcccgggggtttcaacacgggcaggagggtgagcacgtccttcacgctgagtgacccccggcccgtggcccccgtgctggtccagtttccccttttccagacccgggaggccgcctcctctcggcctggccttcacccggcatttcagacccacgcgtgtcgctgggccgtcagcagtctgtttcacgagtgctgagcgctgttcacggttcaggtgaccgcgctgtcctgagccaccgggcgatggccgtctgggtggttcccatcgcgtccagttctaggaaaatgagcgcaaagccaccgtacaacgctctcccgcgggcctccccgtgtgtgtgtcagttttcattctcttggctcgatacgtggtcgtgggaggttccgggtcgcggggcggatgcacgttgacctggacgggaagccgtcccgctgcgtccacacccgcgatgggcagggtcccccgtcccacgtcctcgcccaggccggggcggttggcgcgtcttgttggtgtcgcaacgtggtttgaattgttcacgtcctcgtgggccctccctccacgcctttgttgatgaagtcctgtatgccttgctcctccgtttgggattattgtctcattatcgagtcttcagggttctttacggcttctggatacagctcctttctcaggtacgtggtttgtcccagttcttggcgtctgctcattctgcggacctggtgtctcaggagacgtctgtgcgctgcagcctcaggggggtcgagtcccggagcgcgaggcctccagctccagcttcgtctggtgcagagtttccggtcactcgagtctgcccgccttcctgtgcgctgtcgggtcagcctgtggcgtcgcacggacggtcccgcggggacgttgatggacggcgctgggtctctggacggtgacagtcgacaccgtgacccccgtctgtttgtcccctggtctgtgttgcttgtcgctcttcctgcaacgtcaggacgatgctggacggacgtgagggcagcgtcctcacctcgtccccggggcgaggtcctccttccccaggaagcgtgacgtgggctgtggggtgtggggagcgcgtccctggtcagcgggaggaagctcccgtcccctcaggttgctgaggctccgcgttgcgtcagacgctgccgctccaaggccgtctctgccgtggcctggggatcgggcgccgtgagacaccctcggtggtcgagccagcctggccttcccgagacaaacccgcgtggtcccgatacgctccccgcccgtatgttcctggcctccgtctgcaaaggctacttgtggtgtctggtgacacgagtcttgttttgggtttgaggtgacgccggcctcggagaacggtgggccctgggccgccgcgcccggcccctcgcgtgtcctcacggagccctccttgcaggtacgaagccgagctcagccccgtggaccagaagctgtgcgccctgcggtctccactggcccagaggcccttcttcgaggcgccgtccgcgctgggcgccgtcgagctgtacgagtacgagtgtggggacgcccacctgcagccctcgtgacccgcgccccccgggcaccgtccgtggcggcctgctgcacgcagcggctttcgtgtggagagacaacagggccgtttggctgctgagccgtcttccacaggtgaagtgcgtttgtacggaacggcgaatccttatttattcgacacagaagctgctcagacacggaccctggagcgcgtggccccacccgtccaggaggacgcaccgcccaggaccccctggccgggcccggcggggacaagcgctctcgggcctccgtgggaatcggacggcccctctccagctgcagagacccagcattcgacacgtaccgcgggcctggccggtggtgcatcccgcaggggaacccgtttccgctcccaaaggacctgcctcagggccgcgtggcccgcatggacttccgggcgccgggcggccgtgcgcggttcttctccaggagccagcgcgttccaggagcccggcgccgcggcagccccggaaccttccatccacacgagcggcccagcacagccctccccgcggggtgcgggagggagcgcccactcgggtttgttgatcgttttcctgttgtaaatgtacaaaatgtgtaaagttaactcttatttgcagtgcagagcggtttaaaaatgttttatgaggtcacgtttgtattttgaaataaagaatttaaagattttcagccacagcctcagctcgcccagcccgcgacaccacgttcacagggcacggtgacgccactggggacagacggcagcaccaccaagggagacacggctacactaccaggtagggacaacccgcgggctcaggtgtgggtcaggggcctgagaactcccagcagcctgaccctcctctgacctcctggtgaccccgaccccaccccaggggtggttcctccctagtcggcccccagagtcctgggaaaggacacgaccccacagcatagacgctccgcccgaggccgcaacccggcgcaccgtgtgcagagagaccccgtggaactcagcctcgtgtggggggcagggctgttccggggccgcgaccttgagcccccagccacggccacgcagggacgtgcagaccggttctcatgggtccgtgctcgtctgcacacaacagagaggggaatccgcccctgcagacagaaaaagagacacccccccacacaccctcgccaccccgacgtccggtctccccatctgctctcaggttggcctcaaggggttgtcccctctggcgttcgggtgggcgctggccgtggtttggcaccaacatgagatccagagggcgcgagcggccccaccccaggtgtccgtgggcagggctgccaacgagtgggcctccagggacaaccccacgggcctcctcccctgggctgcagcctcggcccctcccaccaccaccccagtcaggcgcagcccgtctaaagcgtccaggcactgaccaggccgcgggcgagtccctcctgccccccagctgggcccacggcgctggacacgacacaacgctcggcaacagggccctgggccgtgagaggaggagccggtggcccacacggagcaggaccatgcggggtgagggaggtggcaccacactctgcagagaggagcagagtggttccggaaccttcctcccagctgagccgagggcagcgggcagccggagccccgcgaggaagccgtgggcaggcaggcatctgggcaggtgggcaccccgagggtcgacggtcctgtggccctgccctgtgcacggggtgctggctccacaggagcagacggcagggtcaccgtcatgcacctcacagcccggaggccccgaggacccaggtcacccacagaggccgcggcccaggaccgccagccgtggacgcagaacgtggccacaaaggaggaactcaacctgagtcccacccggggtgtgagtcgtctgcagtcagacaccccctggggacagaagggacagcgctcaggacccagtggatgggcgcagggacagacggacacacgggacggcctggcaccctccagggcgcttcccagtcaattcaggagggacctgggaattctcggggagcagcaaatgtcgaggagccagacgggggcccacacctgccacggcctctgggggcttgaggacacaggtgcgaagggccgggggcaacactgaccccgcgggaccttccacacgcctgaccccgagtccctgggtcggtgtgctgaccacccgggtgtccgcacaggggtgtccttccaggagtgtctgcacctccccaagggccaccccagacccgcagctctcacccaggcccagccggcagccccagcccagcccaggcatggcgggggatggggtcagccaggagagccagcgaggaccccagggccccccgaaaaccagtgtcctgagccacagaggcgcggcacgggacccacaccccaccagccttgggcagctgaggaccccgcacgagcctggggcccccagacagtcaggccagcccccaggtgatcatcacaaggcaggcacctgggtgttccgcccccacagggagccccgagtcactcccaccaggacccgaatccgtttgactgaatgtgcaaaggactctgctcccgccccccaccctgggcacagaggccgccatgtcactgggaggccccctcagatgaggtgtcccgcttctccctgacctgcggcctgggggcaggggcaggagaaggcagcccccatgtggcgcccggtctgcgcccagtcagcatcctctctagccccgtcaatgccccatgtggccaccacccagaggccccgcccgggacgtaccccctgggtagagacacgcacatcaatgtcttcattagaagagttctcggagtcctcgaaggacaggacgttgacatcagaggtgtccctgcaggtgacagagggtggcgagtcagtcctccactctcggctgccagcaacccagcggcaggacacgcccccagcagcctcctctcaaacctcgatccctgttgagagactgaggcaggagaccaggtgggagcaggagccctggaggcgacaagcctggacagtcgtggaaaaacaaaagaaaagatggagtctgatggaggaggacacagagaggaacagagaaagagacaaaggaggcagagcccccagggtgtggacacccagtggcatctgacactccgccgtgtcccctctgttgagcctcaggcagtcaggggaggtgggaagtgccccttgctgccccctcgagcacattccgccaggacagcactgtccctgcacgtcctcccctgtcccagacccaggcaggacccggtctgaccagtgtccccaaacagctagcccgactttgggactgcggccaccccaaagctccactccttgagaaatgcttggaaaaaccctcgaggctgatgatgcagagacaggccggcaggttctggacaagctgtccccaagcacagaccctgcacccgacacacaggagatggccgcacctcttggccttgcagcccctggacgggttccttgggtctctgtcggctgcagtggagctggccagggtgtctggtgtccagggggagcaccttcccacaggcagctctgcagagccaggagcggtcagctgtgaggccacactggggcccctccccgaccttgaggatgaacctcccccttgatcccatgacacttcccaccctggggacaccccccacctcgaggatgcttgctgtctttgcatctggcgtcaaacggattggcagcgggttcctcctcccccagggccacgtcgttcgtcctcatgagggccctgaggtagatgagcaggggttcacgttcccttcccagaaggctggcatgtcctcggagatggagtcctggaagtgggcgagtctgtgggtgagaggggacaccagacgtaagaaggagggggtggacctggggatacgggtggggaggggacagcctagggacgtgtgcaaggaggggacagacctgagacccaggcaggaaccagacagagacccccaggagcccacccagggtccccccatccgtcccctggtcagacatgagcggcagagacatgggcagcgagaacatgcacgtacaagaaagtgacaggaagtgggggcggtggcagctcagggaggaccaggcctagaggtcaccggcggggtcagattgggctgagagacagaagagggagccctcttgggtgaggaatgcagggccctacaggccagttctgcagcccagagaccacccccacataccctcagccccaagcagcaggctggacgtgcatcccctctaggacgaggcccgtgtgcaacatggtcctccgaccccacctgtcccctctgccagggctgcgcgtccaggtgcatccagcccaccaggccttgggggctacgaggaaggccaagcacggggacggcatacacaccaggacgtgtccctcaacctggacgccccccgcagtgactgctcagggacgtggagcctctccccgagacctgtgtcccccatcctcccccagccccctcctcccgggagctcccacctccgggaccctgggccggtgtaggttcacgcagccccacgctcagccggcaggatcctgcggaacttggcgagcacgagcagggagccggggttgcggaggcgctggtggcccggcagctccagctcctccagggaagcctcggagagggcggaggccagcccgtgcctggggcggggcgtacggcaggggcggggccacggcgaggggcggggcgttgctggggcggggccacggcgaggggcggggcgtgtgccggggcggggccacggtgaggggtggggcgtagggcagtgagcgggggcctaggtcaaaggggtgtgggagggacggagccgacatgaaaggtggggtatgggaggggcctaggcgaggggcgggccctgaaggaggggaggggcggggcgtggggggaggacaaagggcaggggcggggcccggcccaggtgaagggtgtgggaggggcctaggtgcagggcagggtgtgggagggacggagccgacatgataggtgggggtatgggaggggcctaggcgagaggagagccctgaatgaggggtggggcgtggggggagcacatagggcaggggcggggcccaggtgaagggtgtgggagaggcctagacgaggggcggggcctggatgaggggaggggcgtggcatgggaggggtgggccgtaggacaggggcggggcccaggtgaaagggtggtgggggccccggcaaggggcggggcctgaatgagggatggggcgtgggaggggcggctcggagggcgggaggacggaccaggacccctccgcccccagcgccacctgtgatcctgggcgcggcgtctcgggcaccttggaagccgagctcgagcgggaaggcggggggtgggcgaggtggggccgcagatgacccgggcggggtcgcggcccaggccgtgcgtgtccacgtgcttctgaaacagcggaggaggagggggctgtcggagcctgggggtccagggtcggggcgacctcgctggggggcaccctgggcctcgggtctgggggtggccggtgctccgcgttccggagtgagcagggggtggcgccccgtgtcccggagtctgggcatccgtgtctgcgcgttgacgccccttccaggtgaagggggcgggggtgggggcgggggcgagggctgctcccccaacggaccccacagacgctggaaaaccggtgctgcagcagcccccccaccacaggcgtgcacaccgcgcgtctctgcccagggtgggccgcacctgcggagggccgggaccttgcccacacccccgactacttcagggaagccccggggcctctggatcaggctgtgaacccaggacacgtgggcagcctccccatcccctccgcaggcgacccaggttcaagagaatccagaaaagaacccagaagaatctcggcctgcctccaaaactgccccctggccctccgcaaagatgaaaagcagaaataaatgacgggatcccagaaaccagtcagtcttctgctcaaggagaaggccacacgccagcccaggcagaagcagaggtgccaggctcctccggacagccgacctgaggccgaggcgattctcacgggggcacagaccgctgacccgcaggacgcagataacagacggtggagatgtggggacccgcacgctgccccacggcccctgcgggggtacaccgacaccacccgtgttccatctgctcagcaagagctccgacggcctccgagacgacgaacccaaccgcacgctgccgacgagggaagatgctcacgattccccaagcgaggaaagcacgcacggaacaggccgcagggagcctggcgcgtccaccagcgctggacgtggggaactttcggttggtctgaacgttttatgtgcagacgacgtctacgaggagaaacaagatgctcttccccctgaggaacaaagtgcaggaaaaaattaagtctaaagggagacctcagtgtagacaaaagaatctgcatgaccctccagaaacgggacaggacaaccgccagttctggcagaactgtgaggccgaggccgacaagtgtcctgggaaaggcccggtcacctcgccctgtaggcaccacaggatcctgcaggatggaggtgccgacccgggacgccacgctcagtgctcccagagaccgtagacacactgtgcgccccggccaggcgaccaagccaggaggatggtgaggaagggacggcggcgtctcctctaagacgatgaggttctgggaccactcgggcgcctaagtcaacatggcgcctttctcaacacgaggggcatctcctgacacctctaggtgacccctcgtgacatgaaagccagacagatgggtctgggagacggaacaaggcggcaccgagatgcagagcagaacacaggccacgcctcacggctgtggattccacacatcacagccgtggagcccacgtatcggggtaaactgtctcccgtgaggattctgtacaatctccttctggaaacgtccgccctgagacacggggagagagacaccctcaagtcactgctgggcagcacgagtcccgacgtccccacacagggacacacgtggagtccacaccggtacccagggggctccctatgacaggacgggccccggtcaggagcacggggggggggggtctgtggatcgtctgcagttcaaacacagaacagagagggtgtgggaacctgcgcgcacacacatggggttagggacgcctgtctccgacgtgggcagacaccctgcagctgcgtaggacgccccgccccgtacagcacgcgcgcgagtcccctgggtccgtgcagctcagagggcaggaacgtccccgggctcagctagaaaagccgccccacggggtactatcgagcccacacagaagcacggccgctcccggccaggccaatgggggcgagacccccatccggccaggagaccagggcacatgacccccgcgtgatggccttaggagctgtgggaggtcagcggggtcagacgaggtcaggagggcggaggtcccgcgatggggtcaggtcctaacaagagtcacagagctgcctcccgtctctgctgcgagcacacagcgaggaggggccatcggtgaccccaaagagaacccggaactgggggaaataaagacaataaaaataaaataaataaagtaaaataaagtaatctgatgtttaagccgccccgattacggtccttcgttacggccgccagaaccaagacgccaggacgcgctgttgtcacgagcgactgcagaccaaccgctaatgcggtgacgcttcctaagaaggaagaggaacagccggacccgggtgagtcccggtgacgcccgccaccctgcaggccaggcagctccgtcccgtggggcagcggccaaccttccggaacagcccgctcacctgcggcaggtggaggcgcgggcacagcacgttctggggcctgtccttctgcctcatcctcctcgcggtgtcctggatggcgtcgcagaaacaacggggaggctgtaagtcagacagacggacggacggacggctaccgcagcaagtggggtgcctgcgacagcccacgggggagccggtccccgagcccttggagtgagtgcaccttcagagcgggcccagctcatggccgctgcatcgggccctcgacctggggaatgatgaggagtgagggagcaacacccctcacagccgcgctgaccgtcccgttccaggcctgagccagcccgtgggcgcacggccgcgtgtcagcaacaagagggcgccccggcgcagcctccaggatggatgggggctcagcccacactggtttacaaggtggtcgtgggccgggaggagaccaacccgaggagcgcgaggcgcagaaaaaaccaggggagactggagggttacggttaaaaaaggtaaagaaagaagagcccaccatagaaataaaagctctcaattaaaaggaatccagggaaagtcctcgcaacagataaagggctaaagtcgccaccgtgttacagacacaccaagagtctacacctgcacagtcctggagggaaagtgacactgactgacagacatgtctgtccactcgtctgtccaaccatctacccatctacccaccactcgacccatccatcatccacccatttacccacccaccacccacccacccatccatccccctgtccacccacatacccactcgtccatccatccctccctcccccttcctcccacccccgcatccattcaaaccttttccagctccttgtcatcaccaggcactgccctaaacaacgatccaatcagaccccccaaaaccccgtccctgccctcatggagcttccattcaatctcagtagtaatgagagaacgaaactgaaacaatgaccctctccacctgacgagaaggcacagatcacaaaacgtgacgtcctaacggaaacacgcaccaggagataggtttgggaggagctgttaacaacataaaaatcctgatgagctgttaaggggcgatgccgtccacaacaacacagagcgcctttgtccagacagacaaggaacagggtcgacaacaggggagcccctgagactgcggctgttcccctcttctgcgttcactgcacctgcggaacctccgaccacaagcctgtatcttacgcagggagaaagtggcacggacgcggggtgaagccaggactgggcgaggcaggagggcggacctccaggtagaagggtggacctcggccgccgcctgcatctccacctcgtcagagacccctgcgaacagcccctcgggatgaagagctgacccggatgagaaggggtcatgcccacaccggtccccacagggtccctgctgctcaggctgcgtgggggagggagctgcacacaccacgcaccacggcgttaaatccaccaaggggacgagaaccgcgtcccttcctcctttgcatcctggagcccagcagacaggttttatgccaagggtccgacaccgggcaggactccatgcgggttgggcatgtcgggcggggccgggatgtgcgctcaggtcccaggatcctctctgggagctgctgccgggagcacgatggatcaggaccaccaccggcccccttgacccctacagcatggacctgggcccacacatggtaagctcccaagtgtgccagggccccttgtttccccaattccacccccgacgttgagtcccccagaccccagccccccgtgaaccttgtgcagcagcctgaacccagaggacaccgcggtggatggacaggggacgcagctcagagacccagggaggcggcgcaccccacgggccgcgggagagcagccctcaaggcccaggccgcctcgcgcctccggctccccctcctgccccaggcccgactgtggccccgcctcctccaggagcacgtgctccttgaggaaggcgaccagcgtgctctgcaggacatggccgggccctggcggctcaggatcagcagcagatcgcagagcaggaggaaggcccggcgggcagtgaggggcatccgtccaccctaagaggacagatcccgcccccaccccccgcagccccccaggacccagtggaccagcacccccaggccttccacaagcaggaaggtgcaaacgaaacatgggggacatttactgacgtcgaaggacctgctatgcaacgccaggacacgaggtgacgggcacaatggcacgcaaacacagcaacatgtatgtgcgaacaacacacacaactgccaaagtgactaaaaaaacctgagctgagctggacggggacggcctgcgggcgggggggggggggggggcctcacgccctcccctgtcaatcaccccagacaggaagacatccgggctcgcgtctccaatgggaagtaccgctgcggcatggagggaagatgctcaccccacccagcaacagcccagccaatcagcgatgccgcagctaagccaaggacaaacagctcaaccaatcagaaacaccacagcccagccaatcagaaacagcccagccaatgaaaaccggcatagcccagcgaatcagaagtgccgcagctcagccaatgagaaacagctcagccaatgagtgacactgcaactcagccaatcagaaacactacagctcaacgagaaccagctcagccaatcagaaacagctgagccaatgcggagccgttcccgccctggtccgtccctcttcggatggccctttcttcagagcggccccgccctccccctttctctgtaaaggcagctcccccgttctctggatttgcctgtggttctccacagcacgcacgtcctgagttgcaattctttggtctattcctgaacagactcattttgagataaaataacaggcaaatttgctttttaagttgccacaagatgcaaacacacaacatacatacaacacgcaaacatacaaacacacaacatgcatacgatgtgcaaacaacaaacactacatacaaacgatgaactggggaaacgtctgcaggagagaggccggcactgtggctgtgaaccagaaacgcacaaacgaacaaaaaaggaccaacgcacacgcataacaggcgatcccagagaaaatgcccaaacccttgaccccctagtaatcaaacatccaccaaatgagacattttttctctaagatattggtaaaagctcctttttaaattgacgcccaatttgctgtgcaaagcagcagctcctcatggtgcatggaggacggcagaaaactgagtgactcgccccgagccgcaaagcgctcagaacagcttcattccagggcccgcccggtggtacagcggttaagtttgcacgttctgctttggtggcctgggattcactggttcggatcccgagtgtggacatggcaccacttggcacgccatgctgtggtagatgtcccacatataaagtagaggaagatggacatgatcttagctcagggccagtcttcctcagcaaaaagaggaggattggcagcagatgttagctcagggctaatcttcctcaaaaataaaaaaaaaaagcttcatccctggcacgagattgacccgtcaacatttcatccacgggaacaaccagccgagttccagcatgaactctgagcgtgtccatcaaccccacagacgtctaaagggtgggctgtggctgtgcaaatgggacgttcacacaattccttctcagcgttcggggaaagacgccgtcgtctgacacccgtgtaagatgtgtagacgccgtcacgtaaaacaccacacaccccgactttcccacgcacggggcactttcaccttcccgcctcttgctcctctgaccctggggacggcccggccaggacagagagcgtgacagaccccctctcgctcagcgccccactctggtggttcaggcccatgcggcagccaggtcaggccttgagcagcctctccctgaagcccaggagccccgtcagcgggagcgcaggcaccgcctcagaggttagcatgtgcgtgatgtacccgcccgcctgcactggctctgcccggccatctgtccaacacacacgggccatgcgatgacggaggcggtgagggaggccatcccaacagccgcgccatgggcttgggacccggggccccaccaggccacagacctgggcgagtccctgatgcgacagagctcggttctcccgtcggtgaacgtgggtagaagttggtctggccggaaggcgatggtggatggacaaactgaccgcaaacccgtgttgtgccatgggcgccacccagacgccaggtcccagcacagcagggtgcagctccagggctgcctcaggccagacgtgacaaaacacaccctctaaggacaaagggcgtgtggggagtgagcgggtcagtcctgtgtgctcatgccgacaggctacggtgcccggggctcacgtggcggctgctgtgaaggtgccgtgtgcacgaggttaacctgcagccagcggacccgaggtcagggagatgacctcagtaatgagggtgggcctcgtccaatcaagtgagggccaaacagcagagactgaggtctcgggacgagattctgcctccagaccaggacagagaaacccgcccgagacccggctgccctcggatttccgacacccagcccacaggccagcgagccaaacctccaaatcaatctcccgacggccgtgttctgcgcgtctgtttcctgagaccctgagggacacgcggaggctgctcctcccaccagctcctgaccgagcccgacagctgggacgtcaaacaataacaaacgagactccaggaccagaccctcggaggtccacactgccaccccacagaactgtcaccagaccagggagcgctcggggcggggcgggggcaggcgctcagagattatttgaatctcaccccacacgatcggtggaccggccacgtggcagtatgggcgatggcccaagtcagccctcctgtgagagccaacgagcccaggccggcccccaggatgacggacgcctgccaacaggggggacaagttgccggtcaaaacgcggacaccacccctgtccttctcgtgtcccctccagaccccacatctagaactgacctccaccaggtcccccgccacctggggcagcagcggctgtgtggccgccacgatctgccagaggagtgcacagtaggcacactggagcgcacagtgcaccacctgcaggacacggggctgtcccggggtcggggatggacgggggacccgccctggggaccttccccacctgaccccctcccccagcaccatccccacctctgaccccccagggccctccccaccaccctcacctcggtgggcaggctgccctggtgccactggaaggtcagcaggctgtccatcttctcacacaggttccaggggcgcagggcgtgcgcactgaccagaaacacacacacacagagtcagggggctgacggctcgtctcaggtgcacgggctcagtgggcgctcgacgtcccccgggcgagccgctgacactgcccgacaggccctggaaccgagggctcagccgccccaggcggcccaggtggggctccctccagcgcacacgcccagtgcctgactggccgaggcctcggtcccagctccaggggacacggctctggccccagacgggctgctcggaggggggacgggctcccaggtgccccagggccccccccacacccacgggctgacccttgacctccgggccctcctggcctcccctcaccaggaccagagacggggatgggtgtccgagggaggacgacagccctgtgcttggggctcgtgtgtgaccccgaggcagcctccgcgtgcccggctcacccagaggaggcggcccgtctccacagccgggggcagacccgcaccatctccccgcgtcccggaacaggcctggttcctgcacagcgcgcagacagcggagggcgcggtcagcaaggcgacaccttcctggcggcccgtcctccctgggacaccggcctgcgtccccacccgcgctgtgtcctccctctttccagagggcggccctggaagacgggcacaggagccagagccgcgctcggcctctgcaggagacggacgtttgccatgacggggccagaggacgccctgtgcacgcggccggcgaggaagggaaacagtcacgtgcagacccgccgcctgcacgcatgtcccccgtccctgcacctcgcgcctccccaggggcacccgccccacgaaggggtctccactttgggcggagaaggcgggcggggaaccgcgatgccggcctctcagaccccagactgacggtggcacctgggtcgggggaagcgagacgggacccagtccttcagggacaagcggctcctcacaaggaaagggcccggatcagggctggcagccccgccctcaggcctctcgccctcaaccgcctctgccaataaagttttattggaacggcctgtgtcaataaagttttatcgaaaccacgtgtgtcaataaagctttatcaaaaccgcatgtgtcaataaagctttattggaacacctgtgtcagtgaagtttattggaagggctggtgtcaataaagttttattggaaccgcgtgtgtcaatgaagtttcatggggacacagcccactgggtcacgtgacgtgtgtgctggtctcacactaacacacggacaggatgacctgacggcatgaaaatgatcacaaccagcccttcacaggaaccgtctgccgaccaggaccacgtagacaagcgctgcccgggtgaggctgtgcttcctgggcaccccggggaccatgcagcacgcttgtgaccccacatctattcacgcccaggggtaggagcaccagcacacgcccagcgggaacactcaggaccacagaacgcggcctgtgtccccagagaccagagggggtccccaggaggacggtttgtcaaagctccatgcaacagaaacgatggcgcccagacgcactcagtcagcatgtgagtcctgctgagacgtcccgacaccctagaacctcacatgggacccgcccagagacactcacacgccaccaacagccacacctcccgccacaggcacaggcccagcgtgcgggcagcacgaccaccagagcagcaaccaacaccagctgtgagtgaggggacgtgatgagagagtgggggccgcgtcagctctgtgaccctcatccctgcacggggagctcacccttgtgcacgaggtcgtccacttcctgacagtaaatcagcgtccatgcttctcctgcgtcaggcacatccacaccgtcccgttgtttttagctcccgaaatcccacaggtgacgtcctcgctgtctcgggcgcgtccgtgtcagcatcccgctcggccgggcctttcctgtggtccaggcctgtctcctgcagggacgcacgagcagtggggtgactcccctcatccctgcaccccaggcgcatcctgggctcctggaggaggcgtccaaggtgggagtgggcaggggagccgcacggcctggggctttgggtgccgcccacaccccacccccacgtcggtgtccccacaaccacaggcctggggtctccaaacggccaagcctgcagcctgaagggacccaggacaggacggctaaacgtcacggggtcctcggccgacactgagtggggctcagagaagctgtgatgcagccgtgagcacaggccccgtgaggacgtccacgccatccagcccagtgcccgcgatcgacggcggtgacgtggctgctaagggtcacctgtgggccacgcacgcacgcatttctagagccggattcagtctgcagcccactcgcaagtgcgcctgcgaccacacaggtacacgcatgcaccaacacatgcacatggaaacacaccgcatgcaccgtgcacacgtgtgtgccagcacatgcacagcacacacgggcacatgcacacacacgtgcacagggaacacagggaacgcagggcaaagttctacgtatttttccctttttctcaggtgcaatgtttttcaaaataacaagtgaaaaacgttaatggtaaacgacttttgactcataggactttctgaagatgttccacacatattgtgagacatgagaaattactgtagatcctacatctgccatcaatggatgaagaaacaaaacgcagtccatccccacagtggaatattacgcagccctgaaaaggaaggaaactctgtacctggtacatcatgaatgggtcttgacgacaagatgctcagtgacgtcagccgacacagacggacagatactgtgtgactccactcacaggaggtcacagaggagtcagatgcatagaaacagaaagtagacgtggagccaggtctgagagaggggggtggggactccgtttaatggcgtggacggggacaccgcagccacgaggagccaaacctgagtcttccacagcaggtcagagctgagggactgaaggctgcacgtggcgggggccacgaggatgaggacacgacggtcacacacatggggcctcatgggaagggctcgcgggggctcccgagtcacgtcctgtcttgattcggatggcggctacgtgatcccacgttatacggattcgttacacgtgtacaacacaccctgtaataaccattacagtctgtaatttttttatgaaaaggggtcttcccaccccgtgcaaaggcccttccccaggagcgttcagagtgtggccacctccacccgttccagaaccttccatcacccacacctgcctgcagcctcactccccatccagcccccacgtgatatctcggcggatccacctgctctcgttctcccatcagtggcctcgacgccgtgtgtcctcatgtgcgccttccacccccgagcaccgtgtgctgggaccatccgtgctgcggccacgtgtcggcctcggttgctgttcacagctgaaccacacccgccctgtccgctcacggctccgggactcacgcggactccggccagtccacacggctgctgagaagtcacctccctcacgctgggcatcgacctgggaggctccatgtggaggctgaagatgagcctcacgggccctgcagacaccacgctgcccacagccccggggagaggagggcgtggtggccacgtgtgtgcacggcaccagcagggagcacgtgtgtgtgatcgcgagcacgtgacgggcccgcgggcagggcaggcggggctgcagtcagtgccctctccaccggcctcccggccccaccaggggtccctgcgcctgatcccagacataagacaagacggccgccccgcacggcaccctcgcgtccacgggggcgagcggggcgcatcctcccactcgctggctggatctgctccacgctcctctcacgccaggcgggatgacgcgcacggcctcgcggggaatcccagacgtggaaaccacgccgctgctgaggagacccggacgatccggggaaggagacaaaagagccggggcagccgcgtcctcacggcttccacgtcgcacacgggctgttccacgcgacttccaggcaccagccgcaagggcccagcatcaccagagaccccgcgaggaggggtgtcctgaccccgggggtcgcgccgcagggtgcgtggagggcgggggccaaggaggggccagaagagtccccaaggagaccccagggagacaggcagcaccgtgggtggagaggggccccgggtctgaggacggaggggacgcgaggaagggaagatgaaggccgtcccaggcacaggcatcccacaggcgactccgggcaccggcaggctgggcgggtccctgctgagccctgttatcaccgtcctgttccccaaacactcgctgttccacgtccccgtgagtcgcctgtctccccgcgaagcccaggcccccccacaccctccttgtctccggccgacaattcaagcaaagagcctgcgccatccgggcgtcgctcaggcttcccgggtctccgcacgtccactgtggtgaaccttgatccactttctcctgttagtcggtctcgtgtccgtttaacccgcaggccggccagaaggacccacgtggtacaggccgtgtctcggtcccctgcacacctgacacgagggttcactccacacggggcacggacctaacgctgagatggaaaccacgaaactttcagaacaaacataggaggaaaattctgcaacgtagggttaaaatgttttgattgatcacaaaaagcatcatccataaaagagcagatacatcggagttcatcaaaattcaaaacttttgctccagaaaacacattgtttgaggaaatgaaaagacaaggcaccgtctgatagaaaaatacgtgcaaaggacacgtccagtgaaggagctttatcaagactttataaaacaaggctcaaaactcaacagaaagaagacaagcaaatcaataaaaatgaccagcaacggcctgcccagtggcggttaagttcacacattcctctttgacggccttggcctggggttcgcaggttcggatcccgggtgtggacgtggcatcgcttgtgaagccatgctgtggcaggcgtcccacatataaactggaggaaggtgggcaccgatggtagctcagggccagtcttcctcagcaagaaaaaaaaaaaaagaccagcaaaagattgcaacacactcctcacgaaagcatacatatggatccaaagatgctcagcatcagagaaacgggattaaaaccacagcaaacaccacttcctgactatcacaacggctaaaaccaacaaggctgacgagcacaggagcgtgtgaggccactggactctcccaccgcagacgggagcgtgaaacagtgtgaccagggtggacgacagcttgggggtctcgcaaaaagcacacgttccagactccagccactcgctgccggtcccgacccaggagaaacgaaggcccatttccgggcaaaggcttgtgcacagaagtccctacagcggctccacctgggcaccgagcaggaaaacctgggcctacgcgacggagggagacgcccgcacggacgcagcctcaggacacacgtctcacggaggcggcactgctcccgcccgagtcgcccagacccgcctcccctgcgacatcagaactgctcagccaggaagctgcagccccccgcccgccgggccgcgcacccccaagcccacttacaggggcccaaccgtgttcaaggcccaaatcagcaattccgccacattctgggggcttctccagggcagcgacaccgaccacactgaggctgctgtgtatttccattgtgagatgcacgaggggggaccatgaagcagtgagctcgctgcaccgcggtcacgtccccacagacacacgtaaggccgacgaacagagggaggaaatcagttacaaaacacccgtcggaccccattccaggcaggcggtccacacacaatgtgcagtaaatacagagctgcacactgactggcagcatattcgggacacattaagctaaacattttacaaagcaacacagacaacacgatacgacacatacagtaacatggtgcggtgcgtacacccgtcccaggccgacgcgccgcgcatctgtcctcagtttcctcctctccccccagatcttcccgtggcctcatcgtcacaaagggtgtggaccacccgagctcaccaactcgtgaagtcagcatcctaagtttgaattcagtctcgtcccgtccacaggcaaatggcaccaggatggtccacgtctttcggcggcaacgctgagtcaagatccc

SEQ ID NO: 113 - DNA, 37613 bp, Equus caballus
aaaaaaaaaaaaagaaggacacgatttaaacagcggccgggggtgtagacacgggagagccatcgcgattctcgtcgcgcgtcctcccccggcgccgcctcatttccatttcaatctgggcctcatgaatgtcaaacccgggctgcaaattaataacagggagactccgaggtcgcccccgccggggaaagtgggggggttggcgggtggaggggaccctggcggcgctgcgcaccccactcccccaccccccgcctccacctccacctccacccccgcccggggccctgcattgtgcgccgcccgcgcgccttgaatgacattccagagaaagggcccatgcggagtgacacaaatttatttcggtccccggtgccccacgcggtctattttcctataggatcgcggggtggggtgcgaggttgtgggggggggggcccgctatttgtctggggacaatttagtttccctgaaaaatttaaatggtttctgcgcagacagtggacgggaaatttaatttgtttctcgtttgcaccggaaggtaggaaaaggggagaaggagggcgcgggggacgggctggtaggggcgctgaccccctgctgggcacccccccagcaccccactggatggggactacgggtttggcctccccttggtgaccccttttgaccccaccctcccaaaaaacctccggggaccggccgccttgcaccaacttccagcccggctttggggcggctgccaatcacccggaaaaacgcgtttgcatcgatcccctgtccggatgatttatggcttcatttgagggtaattgaggattaggaagaagattaacaagagtcaacacccgggtccgggtccccggcgctaagcagcgcgccgtttgtcaagacggaacgctgggcgtcagggaggttccgcgggcaccccatcgaattgaatttgggggacgacgcgggagttaatttgacgcgggggacacgaggcgagggtatcgatccccaatcggtcctggggccgcggccccctcgagcacgcaatttagggcccccccccactcccccgcggacggcggccgttccggcgtgacggatacgacggctcctggcgtctgacggcctcggggtggatttggggggggtttccttcctggcggcggaattcgcgacgttcccattcgacgggcacgacggggtgacggcggcgtcgcctccagcgcgatgtccaacgctgagcgtttgccaccaacggggcgacgtgggagggcggggggaggggggatgtgcaagggggtgggacagggagattgggggacccaacccgctaccccgagaccccccccccccgggctttctctgggctggagcatcctgcggtcctcagggagcccgtccccccatttgcatgtgtaaggcctcgctcagaaacaaggccttgtttgcatttgaacagagaggccgatgcgccgcctcaagggggctgttttgctatttgacggccgccccccacccccaccccacccccacccccacccccgcccccgcccctcgtgtgtaggggtttctccagggcccgggggtggcgggtcctcctggctttctttttctggcctcagagtgcagcagatgctgatagaaagcacaacgcagagggcagagggcagagggcagagggcaaagggcagagccccttggggaggaggggacgaggagcatggcacccccggaacccccaactcaggtttgaacccccgccgaggcctcgccccgcgctgggagggaaatcgggggaaatagagggagacccacccactcacgtgtgtcctgcaaatggactggggtcgagagcggccgccgcatggggttgatacgcatgttagggtttaaccacacacgcagttgtacacacgttcacacgcttatacacacgtccacctgcttgtacatacacgtgtgcacacatgcatgcatgcacacgtattcatacacatacaggcatatctgcgtccacaggcttgcacacacatatgtacagacatgttcttgcacacgcatctgcatgcttatccacgcacacattcacacacgtatgcttacacatacaatccacacagctatgcacacatgtatacatgtgcacacacttatgtgagcatccatgtacgcgcacacatttatacacacttataagtatgcagccttatacacacatacacgcagaacacacacgcgtttgcacagatgtgcatacatgtatagatatgaatgcacaagtttgcctgcacccacatgcttatatgtgcacatacacacctgggcacactcttttatccatctggacacactcactcatgcacccaggcaatacgcattcacgtagacacatgaatgctcacttatagcaacgtgcacacgcttatacgtgcacacatttatgccctccaatgtactcacaagtctacatgcttacacacatgtacacgcatgaatacacagatttatacgcacgcagcatggttatacgcacaggcacacacatgaaaacgtccatacatgcacgtgctcatacacacacgtacacatgaaaacgcacacttgcacacgcactcacacacacatatacacagcaatacacacttatccaggcacccacatgcttacacacgcatgcgctctctacacgcacagcgccaagtgtgcaaagccttcccacagcaggcagagtgggcctgacggcccctgcccctcgtcgtcctggcgggtccccccttcctcctgcgccggcaggtgggcgtgcagggcccccgggcaccggcgtctgcagacttgtccctgagctcacggtcaggacggggagctcacttctccagctgcgcttctgtctcaggacgcgtcccccaagcctgggggttgtctttgcatcgttccctgcacggagacttttatggaggcggggcgtcctggtggatccccgactttccataacttcaagtcccttatgggtgagtggggcccagaagtgaggtcacacggggaatggggtctgattagctctcagccgcccccggaaacaccctccctcccaggtcccactcgccatctgctcccagggaaacaaagtcactcttacggggcagagcgtttccagggcggctcagagggggcttcccggggggtggcagccaagggcggacgtcccagctcttttggggtaaagttaagttgtttaccgcatgccgcgcccgggcaaacgagggccccccggccagcagcgtctccacggggtgaacccgaagcctcgtcctttgcagaggcagccgggcccctcctgctggtccctcgacaggggacggacacctgtgcacagaggcggccccccaatccgggtccagggagggtccagagtgggcctgcgtcctgcccggtggctcagggatgcgtgagcagggtctttgcaggcgtgatgaagggaaggatggagaggagggcttcctggaggaggcggccctgaatccaggatggagaggagggcttcctggaggaggcggccctgattccaggatggagaggagggcttcctggaggaggcggccctgaatcaaggatggagaggagggcttcccggaggaggcggccctgaatcaaggatggagaggagggcttcccggaggaggcggccctgaatcaaggatggagaggagggcttcccggaggaggcggccctgaatcaaggatggagaggagggcttcctggaggaggcggccctgaatcaaggatggagaggagggcttcccggaggaggcggccctgaatcaaggatggagaggagggcttcccggaggaggcggccctgaatcaaggatggagaggagggcttcctggaggaggcggccctgaatccaaggacagcgtcctcatcagagacagaagaggagatgcagacgcggaggagcagccccgtgaggacggaggcagagacgggagggaggcggccaccagcccagggaccctggagccccagactcctgtgacccttgacctcagactcctggctccaggaccggggagggcggacccctggggttctaaggccccccaggctgtgtaatttgttgtggaaggtccaggaaatgaacgcactgggttagcccgtctcctcccccaagggaggccccttgccgtcgtcaggtgaagcgtggcccaccgggttccgagtcctgggaggagaggaccaagcagggaacgtcccccggctgccctcgagcatcctgctctgagccccgcccactccgatgacagacaggtcgctcctccaatcagccgggacgtggttgcctggcaacccgcatccggtgagaggagaacccaggaattctgggaaggaaccaagggccctcttcatgttctcgtcgcctttgcagatccgtccagacccggggagcgtccacccttgttggccgtgggcatgaggatggccggacggatggcccatggggccctggcgtggcctccagggaacggggcctcaaacgctttgctgcacccctcggttaatgtcgggtgtcaacttggctgggacacggggtgcccgggcgtttggtcaaacatcatcctgagtgtgtctgggagggcgtttttgggtgagattagcattttcatggatagatggagcagagcagatggtccccccccccccgatgaaggtgggcctcaccaaatcagttgtggggcttaaggaaggttgatcctcctctgaatagaggaggaggccttttgtgtcactgccttcgagacgggacatcagctgttttctgcctccagcctcgacctgaaacattggctgttgctgggtctcaaccctgccggccttcagactggagcttagaccatcggttctccgggtctccaccacgtggacgaggacttgtcagcctgtgtaacgctgtgagccgatgctttgtaataaatctctatgtatgtacctatttatatcgtctatctatcaatctaacctatctatgtaatctataacgatctatgtgccatctatcatctatctatcaatcatgtatctatctatccatccatccatccacccatccatctatctatccatgcatccattgatcgatcgatccatctatctatccatccatccatccatctatcaatccatctatctattcatcgatcgatcaatccatctatccatccacccatccatctatccatcgatcgatcagtccatctatctatccatctatctatctatctatccatcgatcgatccgtctatccatcatccatccatccatccatccatccatctatccatccatctatgtatccatccatctatccatccatctatccattgatcgatcaatccatccatctatgtatccatcgatcgatcgatccgtctatccatccatccatccatccatccatccatccatccatccatctatccatccatccatctatccatccatctatcaatccatcgatcgatcgatccatctatccatccatccatgcatccatcatccatctgtccatccatccatccatctatctatccatctatatatctatctatccatctatcgatctattgatctatccatccgtccatgcctctatccatctgtccatccatcgatccatctatcggatgggtcccgtttctctgtagcaccctgactaacacactgagccacagggcacaaaccatttctaagtctagatgacgccatggacggacgaccccagccccttgctgtccgctaggacgttcgaggacgacggccaccccgaggacctgccctgctggggctctcaccgcgcacgagcggaattcatgtttttcctcctcccattcatttcctcgttcttccatccctgtagacgttcaattttagggtcgttcatccctgaccccataagggacccatttaccacctagaagacggtgtttatgttgaatttcctttttctctttgatcttacagcttctgccccaaacgccgttccccacagctcctcgggtcagctcccttttcctccctcccttgagcgaggttgggcctgatctctgagcagctggatttatttgtcaccgtctgccttgcatctcgggaaccctgacatctcaggcgatttaaaagaaaaaaaaatttccaatgcttaaaattccctcccggggatgtccagctggatggcttctgacaggggcccagagtggtgcgtccaccaccccgtggacacacagcagccccttgaccccattgcccctccgccccagagacccctctgactccgccggtttcccgtccacacccgcagacgaacccacgaggaaggaaaggccccggccggttgatataaaaccctcctattcgtctaatgtgcagagttcattaaacccgcatttaaatttttattgtcaagaatttactgcctcttttgaggcacttagagcgggacgtccaatattacgctgaaatttgtctttaaaagcgtcgtaattcaggggagatgagggaccccaggaaacagccggctgagggctgcgtttctgctttaatttgctgcttcccccgggggtgtgggggagaggaaactgggagaaactggttgaatggggccccacctcctccccccaaaataaagtcatgtccactgggacccgggatgggccttacctggaagcagggtctttgcagctgtgacgaagggaaggatggagaggaggccttcctggaggaggcggccctgaatcaaggatggaggcagagacgagagggaggcggccaccagcccggggaccctggagccccggacgccggaagaggcaggagggaccctcccctggagcctccggagggagcgcggccctgcgacccttgacctcagcctctgggctccaggacggggggaggctgggtctgtggggttctaggcctccaggtttggggtcattcgctgtggcggccccagggcctttgcacaacacgatctagtgtgtggaggcctggaaggctgcaactgggaccccgggctcctccgatgggcgttttcccaggctgccttgcacgtgggcagaagcccccggaacccgcggcggggagatcttgacctttgttgacctttgtgcacggcagcgtccagcaggttccccccaaaaaagcgttttgttcaaagcagccaatgcacttatgtctccacggagtctttgctcccagggacctgcagcccgatcatccgggtcacttggggaccccgaatgcaccccccttgtgcgcggggctcccgggtttgcaagaggaatgctctgcatctttaccagcaaaaaaaaaaaaaaaaaaaagtgacaagtgcttttctcgccttcaataaaaaagcgcttattcccctgaatgtgggtaaaacgtttgtcgttgcacctgtatctgggctccccccccccgaccccccgcggatgagccgaccatgtcgccccccggaacccaataaatccagcggcggagaggatggattcgtccgaaatgaaattgagtcctcagctgcttttcattacgggggccctcgaaaaaataaatggcgtttccgcgggttatttatgcgtccgcgggggcgtaatggccgtaatgattaataccgaattttctgaatttattctaaaaaggccgcttcataaatatggaacagcgtgtgcgccgcgatgcgcaggtagccccgcgcgcgttttattaaaatggaaattcaggaaacatccataaaaaaaaaaaaaaaacgacgacgacggcgagcgttttggagacaggcacccggggggagggtgggggggtagcctggacgcgcatgcgcagaaggagaccccagacttgggggacccgtgtggatttcggggggacgcatcctgagctgttggggtcctaagtggggcagggaggccaggcctggaggagagtttcccccacgtgcctgggaggaacattctggaaagcttccggccatggaggttcccaggttagaccatccgacctggtgccagctccccttgggggggggggtagtggctgcagcagagcagaccccgggttccagattctgacgggtcagaggtgaagggtgcaagcatgggggactctggggagagtcaggcacgagcacttatggagcaccgactgcataccgtgctctccaggttggaccctggggctcctctcaggctgggtccaccctccatgttgtgaagcaaggaaattggcgatgttgtcattaggggtctttagagtcttggctgtgcagcctcagatggggaagaaatgaggggatgagccgcccagcccgttggcctgacattcaaggcccctccaagatggccgcaggtggggggggtgacatccagctttctgtcttctccatggcatctgctccggccacactgttcccggcagtgcccaccagacaaacggccgggttatggggttcgggggctggcctggcaccccggggtcggcatcgaagggcgcagataccaccccaggtgggacggggccagaggacggagaagacaccaggatgcagagctcaggactgtgggtcccaatgggggtccacccgggccagagggaggggagggaacggaggcccagccccttggtgcagcttattccggacggaatattacgcagccctgaaaaaggaaaagcggttctgaccacttgctgctggaggcggagggtggggagaaggtccggcaccgagagtgaataatcctcatggaaactgggggtccgtgtgggttcattgattgcaaccaaggtcccatcgggtgggggacgttgataataggggaggccgtgcctgtgcgggtgcatcgggcttatgggaaatctctgcaccttcctgtccattttcttataaacctataattgctctaacagaaagtcttaaaaataactaaaaatggttcggagggtaaattgggcattatggacaatttatcagcattaaaaaaaaaaaatccagtggtatttcttctttggctgaaaatctcccggtggacacggccagcatcgggccccctgccgtgtgggggtgaccgagggacccccggcctgaagggcgcgtgctgtgcgtccccgagcagagctggttcgggtccgctcgtccttgttgcgattcactgaaagtgagtcaggaggtcctagtggacccccagctcctgagccgtttcctcgttcgaggagaatcgtttcatctccttctttttctcaaaaaaatgcagaccgttggcccgtcctcgactcgatggattggcccccaggacacagctgcatatcctaaaattgtgggtccttccagttgtttccgacgagaaaaggagttcttttcctggcacgacgggagttaaaacaggtaacaacacccgctcttcgtgtgaaagggagaaaatgattttgttttttttgttttttttttcgtaaaaaaaaatatcctgggggcagttgggagaattaggcatcatctcggacggcgcggttttattgagtcagaaattcaataaatacggggtcccggctgccggcgggatgagttattagaatcgtgtcgaggggatcgggacagaagctcctggatgtgggaaatgagattatgggggggcggctgcccgcggggtgaggtctcatagtcgctcggtgcaccttaattatcgtggcccgaccctctgccaccccatgactcgtgtttcttaatatcctcctcacggattctcctttttttttttttcttttttgcggaccccaatctctctccttacagctgaacggggagaatatttattcataggcttttttttttttttttttcggaataattgaccgacttgaaatccacctgccggacaaggagccgtttttttttcagtgtaaaagtcagtggtgtgcggcacatttgtgatgtcgtgagaccaccagctctgtctgcttccacatttgcccccaaggcgaccccgtccccatgagcggtccctcccagccccggcaccaataatccactttgtccccgtggtggatcggcctgttgtggacatttcctatcaatgggatcctgcgctgtgtgtcctttggtgtctggctactgtctctgagcatcgtgttttcaaagtgcatccacgtgtagctgcagctgcgcttgcctcctgttcatggctgcgtaatattccaccgcccagctgcatgaacatgggtgcacacgttttcccggagtccccactttcaatcctcttgggtgtctccccgggggtcaaatgtccaggtcacgggggaaattgcacgtttccctcctggacggacctacccccgggtccttgtcccgtttgcagggtgagcagaaggtgaagggcccacatatgtggatttaacccgagattttcccccaggaggcggtgcccgtgacggcgggccggtcatcgaatgactgagtgaccacacggggtggaaagtggggatgttagcggagaaaaacggaagctgctggcagccccggaggaagcggggtgcaggccgtgccccccaccgtaggtccgtgtgcagagttttaacgcccccaaacgggggccggggacctcccccaccccgagcgagattggctcccccagaggacccaggcgggaactgggagaactttcccgaacagcagccctcggtctgggagccccgggacgcccccccccccaccccgcatgagctgtgtctgtgcctcgaaacggcagccaagcggactccgataactccattacccggatgcggcggggtccgcgtgggcggctggggtgcaggcggcggcgtaatacaaagtgtcagctgaaatgaaaatacagcccgggtaattacatttaattggatcctgtcactttaaatcctcttcgttcgccggggtttccgcggaaccggggcctccggggcgcgcttggctctttattgcgaagagcggggctgacccccgtgtttgtgggggggggcggtggggctccgaacacgacccggggtggggatgggtgcggatccggagacccgcggagttttgttggactttgactccccgctgggagagtgtggtggttacaacgaaatcccggttctgcgaaaagacgccgagtgtgcgcaacgggatggactggaggctgcggggaaacagtgtccacagacgggcaccgtctacactgcgggaaacataatatccacggacaggcaccgtctacactgcgggaaacatggtagccacagacgggcaccgtctacactgtgggaaacaacatccaaagatgggcagtgtctacactgcaggcgccttggagccaacctctccactcagggcaccgtctacactgcaggcgccctgcagccgagctccccgctcagggctgtgcgcacgggaacccgtgcacctcctacggccacttccgggacaccagagcgcagagctgacggccgacaaacgcacccgtttattctgcgtttgacgcgtttgggacgccggccgcctaaacgggtgagttcacgcccttggggccccgagaaggcggcctggttgggacaaagcgggttcgcggacgcagtgaggtcaacagaaggtcatggggggggaacctgctccaataggatccgtgtccttccaggaagaggaggaaacacccggggaagatgcagccccgggacgctgcgtctcctcttctgtgtctgaggaggacgctgtccttggattcagggccgcctcctccaggaagccctcctctccagccttgattcaggaccgcgtcctccaggaagccctcctctccatccttgattcagggccgcctcctccaggaagccctcctctccatccttgattcaggaccgcgtcctccaggaagccctcctctccatccttgattcagggctgcctcctccaggaagccctcctctccatccttgattcagggccgcctcctccaggaagccctcctctccatccttgattcagggccgcctcctccgggaagccctcctctccttccctgcatcgcgcctgcaaagaccacaaggaccgggtgtgcactgatgaggtgtggcccaccggccatgccgggacgggttgtggttccttcagcctctgccgccctgaaatcagggagtttgacgacccgtctggaaggttcgtggcggcgctatttctgttcacgggtcacggtggaatattacgcagccctgaacaggagcgaagccccgacacagcgacacgtggacggaccttgaacccacgatgctcagagatggcagccagacactcaaggacgcacagcgcgagagcccgttgatgtgaaatgtccagaacaggccgatccgcacacagaaagggggtgagtgggtgtcgggggctggaggcaccaagaacggggtgagtccttttgggggtgatggaaatggttcagcaccagacagaggtgctggatgcacagtcccgtggattcactcagtgtcactgctgataaattttatgttatgtggattttagcaaaatgaaaaatagtaaaaaatcgagtctatggccacgggattctggaacattccatggaaggagctcatagggggatctgctggctacaccttctctgccctcagtttccccttcggcttggggtcggtgccccgcgctgggggtggggggttgtggggctcccccatttggcatcatttgaacctgaaactcttctgcaaagagagagcgggtttcttaaaacggatcagggcgcagagcgtgttggaaacgggtcgtattccacctgatcggctgctgcattattcacgccccctgtgaagacgggcggaagtgacgggtggtggttaatctgggggaggggtgcccggtgcctgtctacacccaccctgcccggtggtcgtcctccaggctggatgtggtgatggacggcgccccactggcgcatccagagcgtttgaggccggacaccaccgcacctgttctggggttttggaagagtcacacgagacttttttttttcttttgaggaagattggccctgtcctaactgttgctgccaatcctcctctttttttttttttttttttttttgcttaggaagactggtcctgagctcacatccgtgcccatcttcctctattttatatgtgggatgcccgccgcagcatggcgagccaaggagtgccatgtccacacccgggatcggaactcgtgatcccccaagccaccgggctcccatgcgcgagagttttaatcgcacgtgtctgctctgctcggttgttggggttgctgaccacgcgggtggaggcagcacgcgtccttccggccctaaaaaggcgccaacaggccccgtcttctcactacaaacgggcggaatcgtgtccgtttgggatccaaacccacgagtcagccccgcgccgatccgcgttgcagcgcacgtcgcccctgccggcccgcgtctacgcagcgcctcccgtatgccccgccccccgtccccgcgctccgagctccaacccgctccggatgcgcgcgggagccgccgccggtctccaccgcccgccaaccccacccggtccccgtctgatgtgacaatgacaaagggctcggcgccgactttaaatttcataattttaatccgtcaagcctgacatttaattagtgccctttctcacccgcagccgccggggggtcccccgcggaaaccccgccccctcctcccgccggcccccccccaccccaggcagaaaaccgggttcataaatatgtgcataacttgcaggcggaagacaatgcgcccgccaggctccctgcgcccccggcggtggagacggccccggaggttaagcgtgtttcgaagactcggtttatggcgttaggtccgggggccagtgggtcgtgggaaacgagaaacaggagatgtgggaggcggccgcgagtgtggaccgcgggccagggcacctcgcagcatccggggatcccggggcgtcgccggtgcagtttgcaaacaaggggaggcgagcggggcgccctgagcggcctcccaggggcagggaggggggtgcggggctgagcgggtcttgactcatctggggggcgaggacggggtctctggaccggcatccggggtggtttcacccccagaggagccgaccccacaaggcccgtcttcctttgggtccgagctgctatgtctcgtcgtccaaacggcaagcgtttccatcgaaactcgaccggaacctctttccgactcgggggctgctggggcattttgtcaacaccgtccagcaggaggagagtccacaccggctgctgacagcgggtgggggctcccggggtactttacacaccacatgctttttctttctttctttctttctttttttttgctgaggaagattggccctgagctaacactagcgcccagctccctgtattttatgtgggaggtcgatacagcagggcttatgagtggtgcggaggtcggcccgccaaccccaggccgctgaacccgagtgcacgacctgaaccactgcaccacccggccggcctcagctgatgagagtgggtccacgaggtcgggggcaggtcctcatcttttctaagctgagcttccttcttttggggttcgggagtcagttccagagacaggaacggggcttcagcgcccaccgagtcggtccccggatgaggggtccctggagcacttgggcccctggaggaggagagggctcgccctgtgcccctgtgggcctggctgggccgggcgggtgcagggggaggaatgaaggaggcctgccgggaggaggaggacctggagcagcacagccaggtgcattctgggaaacaggaggagtggggcctgggggaggaatgaaggaggcctgccgggaggaggaggagctggagcagcacaggcaggtgcattctgggaagcaggaggagcgcggcgtcgtgagaactggggtgcagggggagcaggcgtcctgggccgaccccgcccggcacccccagcacccgggacctgctctccgtccttccttcccgacacgctttaggggagatcttgcatcccgaggctcgcctgtgggcgtgtcggatcacaatcgggtccaaggccaatgacacgggggtgaggggaaagagtggctcccgtttggggtgacggaatgttccagaacccaacacatggtggggtggctccgcgacacagtcggtgtgctaaacgcacccaggactgtgcccctcaaacgcttgaaatggccatttctgcgacccgtgtattttcccagagaggaatgtggttccgattctcagaggccccgacggacacagagacaccctctgtatttgtttgtatgtatatatttttttttgctgaggaagattggccctgacctgacatctgttaccaatcctcctttttttttttttttttttttttgctgaggaagattggcccagagctaacatatgttgcaaggacaacctccagctcaatggttcaggactcatatggcctatgacaaagaacttgccattctttctattgattgactattgttatgttttttggtgaggaagattggccctgaattgatatcaattgccaatcttcctcttttgtttttgtttttttttttttcctgctgaggaagattggccccaagccaacatgcgttgtcaattttccaccttttttttttttatttttgctgaggaagattggccctgagctgacatccgtgccagtcttcttctgttttgtatatgggatccgccagccacagagtgacttgatgagcagcaggagggtccccacctgggatcctaaccccggaagcctgggccgctgccggacggcacagcccacggagtccacacgggagggtccatgtggggtttttttcccagccgcatgccctgtacaccctgtttgcaattattttcccattaagtgtgacccctggacggttgggggcacgggaattaggtcctcggaagggcgccgagccgtgtgcactgcaggcagggtgggggtggcgagtggctccctgagctctttttgcttccacttgtcatcctcccaggacggctgaaaagtcgcgtttgcatcctaaacgccgccatccgtcctgctgaagggttctgaatttccccaaagcggggctgagaagcggattaaaactccagccatcaatcctgcccggggcgccataactgagcaccttgtccttgcaggacggactcggcagaagcaatcatccggggaggggacgtcgggaaaaactgcacatgcagaggttggcccggtggctcagtggttaagtgcacacattctggtttggccagtcttcctcagcaaaaaaaaaaaaaaaaaaaaaaaaatgaggaggattgggagcacatgttacctcagggctaatcttcctcagcaaaaaaaaaaaaaaaaaaaaaaaaaaaccctcactcgcaggtactcccaggggccggcgttgtctcccattttccctaatttccctttaagtctcaatctgcctccattggattaaagaaaataaccagcgttcctaagacagcgtctctggtggtgttttcaggacgccgcgtgttgggttccccgagacgaaagatggttttaaaaatggccgcaggtgatgatttttttgtagcttaatttagacgatattgaaaaatgatgagggggggaaagaaacggaagccgcctcattaaacatccccccccccgcttttgcaatttaaagtcccggctccgccgtgcgcgtcgcgcgttcatatttcaacaataagcgttaataacacgggaacgtcgttatttgcataacgcggctctaatggacccgggggacctgcaagcggtgttccgtccgcgatgatttccgtgaggacgagcgggttttggagaaaacggggggcgtttctgccaggtgggggcctctctcccctccggcctctctgctcaggggggaaccagcaggagacagggactcagcgcatcacggatgccagtcttcctcagcaaaaaaaaaaaaaaaagaggattgacagcagttagctcggggctaatcttcctcaaaagaaaaaaaaaaaaaaaggaaataatcctaaaccccgttgtgtccccggacaccagctagtttccgttcctcggggctccggccggagtttcctcacgttgatctgctctttctgccttttctacggacacttggccaattcacaaacaacggagcgagacgccccacccgggaagcgggacgagttccaccggctcaggttttcagatatttcgcgggtttttcggtctaattagccgcatccacgtgatgcgcgtctttgaggattatttatggggcgaggactgtggttttcagggcgggagcctgttgtctctgttttcgcgggtccaacgatgctcccgggggaaccttttcctgagtcccagcccgagcccagccgacgtatgaaccgactcgaaattaaaaccccccaaagtcagtctacaatttatattttatcataaggatctgttttttaaaggtggctcccaaaaccaaagacactgaattgcaaggaagttggaaatccatcttattcaaagtcttttttttttttttttttgctgaggaagactggccctgagctaatatctgctgccctggggctggaggcctcggctccgtgtccgtgtgaggaatgggaatcgatttctgcagttgatatggagcctgtttatgcagaaataggagcctgagccagctcagcgccagtcttcctcagcaaaaaaaagaaaaaaaaaaaggaggattggcaggagatgaaggcctggctgccgtcagatcctccgggatgacgggtcgactgggacgtggacgtgtgttttcgtgggggcacaattcaactggcaaaggatgtgccatggagggcaagctcggatccttcctggaggaagcggaaggcgatattttaaggccatttttcctttgcaggatgaggcccggaacccagcacagaggagaccctggaacatcccagagtgacttacagaccgcacggcccaccgctctccctgactctcccgtgctaatgtcatggggtcaccatatgccgtctgtcgtcgatagagacatcgtgacgtgtcgcgccactggaaacacgatttattgggttttgactctcagttaaaagtctacgagtccggtcccgatgctcccgttgcaagaggggagggaggcccagttacgtctggaggggcgctaagtggcgatcggaaagtcaatcgacaaacccgatgctttcttctgcagccggggctcctccctcgcagccgtttttctttccgtcccacgctcacgcttgatcctaacggttggcgccatttttcctcccggaagcgtgagctgcgcggggccagaggcgcggcctcgggttcggttcctgcaccggtctgctctgcggggacgacggagatcacgggtggaggcaagcgggtcctgactcgcggggtccccggcggccagctcctgctgaggtggaaacgggccctgggcggatgtgaacggatccaaacgggccctgggcgggtgtgaacggatccaaacgcgctctccgcgggtgtgagtcagacacacgtttcttgggggatgtgagtcggacccgctcttgtccgcagtaattggaagggtggtccccgtggggcgcgcaccccccaggccccgaccctgcgccaaagaaaacgcccgttttctccattttcctttttcctgcccatttgacaaaattatattccatggggccacgcaatgcaatttctgggataatattcaaggaagggggagagaagaaaaaaaaaaaatcctgcattttctttcatttctgtcagaatcaatcaaattgtacgaaagggaacatcatctccgagaaggaaaaacgagcgtttttccggccggatcagcgtcctccgtgcgggaacatgcacatattgaagaggtctccgttttcccgtttttcttttttttctttttttttttaatcatgcctaattagttttttttttttaatcacccacacaagtaagacgctcgcctgcataatttatgacatcgaggggcccgtgtcagaaatcaaatgttgtaaattaaaaataacaagttggagacgagtgattcaattaaaacccagaaaacattggattatgcataattgagagcttgtacgggggggacgcgtgtcacccctgtcagctcggatgggaagattgcattggggctgtcagggccgtttaaatcaaacgggtaaaaaaatcggaaaacaaagatgatgtttcttatgaacttccagcgttcggaaataacggccggggtgtctgcaaattgaatgcttagacgacgggctctatgtggagggcacgtgccaggctccggaggccgggccgggggaacggggagcgtccgacggtggccgttggagggcaccccgggaggagggggggtctatgcaggaccgggggcaccccgaggacccccatctgggtccccatcacccacccctgaaatttgtcttcttggtgatgacggcggctccaaacgctcagcgtttcccggaagcagcgtcgtgatttccagaaattcgcacggggagcgtccgcgtggagaatgagtcctggtgcccccgggggggagggaaacggaagctgcaggcgcgtccttgggtggggggtgcaaggtcccatcagaaaacggcacccaacgatgagcgttttggctccataagcggctccaggggggcgtcaccaacggcaccccccgtttgcgtgaggaaggacccaggagcacgtggccttcgaaccggtgtccggtgggtcagcgaggaacccccccccccaaacccgggctaacggcacagaggacgctgggcgtccgtctaatccgccacgcacagagcggggctctgggacagccgtctgggctctccgtgcctcagtttcctcttccgtgaatatatatagagatatgatacatttctataggcagagatagggtatagatataaagagagagataaagacgatcaagttatagctatcgatagacgtagagttatagatcgttacagatatagatatagattcaaatatggtggtggatatagatgtagctgtagatacggttatagatatgacgtagctgtgtagatatgatatagttttatagatattatagatatagttgtagatatagttgtagatatagatatgatatagctttatagatatgatagttatagatatggcatagatttagatatagatatgataaaatcagatatcaatatgacagagttatagaaatgatagagatatagatatgatatcgatatagatatgatagttatagatatgatatcgatatagatgtgatagagttatagatatgatatcgatatagatatgatagttatagatatgatatcgatatagatgtgatagagttatagatatgatatcgatatagatatgatagttatagatatgatatcgatatagatgtgatagagttatagatatgatatcgatatagatatgatagttatagatatgatatcgatatagatgtgatagagttatagatatgatatcgatatagatatgatagaattatagatatgatagaattatagatatgatggagttatagatatgatagacatagatatgatattgatatcgatatagatatgatatagctttataaatatgatagttatagatatggcatagatatagatatagatatagatatgataaagtcagatatcgatatgacagagttatagatatgatggagttatagatatatcgatatagatatgatagacctatagatataatatcaatatcgatatagatatgatatagctttatagatatagatatgatagttataggtatggcatagatatagttatagatatagatatgatagcgttataaatatggcatcgatatagttacagatatagatacagataatagttataaatatagatatatagatatagatatagatacgatataactatatagatatagttatagatatagttgtagatatagatatgatatagctgtatagatatagatatgatagttatagatatggcatcgatatagttatatatatagatatagataatagttataaatatagatatattgatatagatacgatataactatatagatatagatacagatatggttatagataaagatatgatgtaggtttatagatagagagttgtagacagttatggatatagcgacacagatacagatatgatatagttatagatatgacatacttatatagataagctatagttacaggtctagataagacacaacatagttttagagatatacatatgaaaaagtcagatgtagatatgaagttatagatatgatatagatacagatatgatataggtatagatatagatacgatggagttatagatatgatatagatatagatgggatggagttatagatatgatatagatatagatatagatatgacagagttatgtagatagagttgtagatacagatgatatagtttgatagctatagatgtagtatttttatagatatgatatagctatttagatataaatattatatagttatagatatagatatgacatagttatagctacagatataggtagagttatagatacggatatgcatagaatgatagatacaatatgatacagctctgtcgatatacacatgatacagagttatagatccagtatagctatatagatgcaatatagttatagacatagacatatatttatggataggatccagatatagttaatgatctagataaagttattgatccagatataggtaatgatccagatatagttattgatccagatatagttaatgatctggatatagttaatcatccagttatagttattgatctagatatagttattgatccagatatagttattgacctagatatagttattgatccagatatagttaatgatctggatatagttaatcatccagttatagttattgatctagcgatagttattgatccagatatagttaatgatctggatatagttaatcatccagttatagttattgatctagatatagttattgatccagatatagttattggtctagatacacttattgatctagatataggtaaggatctagatatagttactgatctggatatagttaatgatctagttatagttattgatgtagatatagttattgatccagatatagttattgatctagatatagttgtgggtctagttgtagatacagatatagactgactacccgacggtgcactgtcttcttgtccccgtttcctcaggtccagtttgggcacattcatcgtctcctgatccaaactcacgtggttcctgcacgaatttccacctccccccggctccttcctcttctgcgctgacacttctctctgtcgtattcccgtctggcgtcgggctgccggccgcacgttttctccatttttctcttctgaaaacgtcttgcttccgcctgttgggaagtctgcgtggggattctgttgattgatagactatcgttctgtgtcggtcaaaagaaatcccgaacggcagacagtgagggcgccgttagacctcctactaaggagcagggagaaagccaggaggcctgcccagaggaggaagcacgtgaggaggcggtgtcggcacaaacccacgtcttgcagacaaaagggcacgacctcggggggtgggggagccccaatggtggggaaggtcccaacggggaggaagggggaccccaatggggggggaggtcccaacggcggggacgccctgagcagtggggtcccggggtcccaggtggccatgcaccccgtcctttacattgcacggaccccgcagtgtgcacgggggtccgcccccgtcttccagccggcagtgacctttgctcctgggcccccccttctccacaatagcacgaaacacctcagaccgcggccaccgaggcgccttttaagccactgaggagatctgagcagaccgtttgggggcgtgtcggcccctctccgcccccaaacgccgaccccggttacgatatttcctacaaacccacgtgccggggaggcaccgtccacgtcctccctctcgcccccatgtctgtttcatatatgcggcgggataaggtggtcgtggggtctccgtgtgtctcgtggggcccgtcctggcgtttgtctccgccccatggctgacgggggtcggcttgagtcctgtccgacttcccacgtgggagacgtcccccgactcagggcctctgaacggcacctgattgggaaaccgggtcggtgcagtagcttttagggaagttagcagtcgcgagggtggggcctaatctgacgcccggcgtttcctgtaaaaaaaacggcaaacggtcacgtgtctggagggacccacgcgaggagggcgggttcccctccacgggcctcagaagcaaccagccgttgacggcgtcggagtctggtctccggaaccgggaggcgataaacgataaacgtctgtggcgtttggcacccccgtttggggtcgtttgcggctgcagcctcgggaaacgcggaagccgggtgcgcgaatccatcgatcttatgatccgtgatgcgcctttggaacgacgtgtcctcggtctccacacgccgcgtctacacagcacggaaagagccgggaggcagcgtccactctcagtcgtaaaatacggttcatgagtcgcactcagaacacagggaaagtgtagacgagagtctacacagaactctgagccattgttgaggccgaatttttggggtcaggcaggcggcgtatgagtggtgggggtgatgtaccccaaaagcacccccgggcccttcccactggggccaccaggccgaccttgccctcgtcctgctctccgtcaggtccgtgtgtgtctggatcaaaagggcagcgtggagcataaacgcacctgtgaatgtgcgcagagtctgttcatttaaaaaaatctggtttgctcaaagatggtaactgtccacgcagccttctcctctggagcctaaagcagcccacttgctatttactattttttataaagaatccaatgggcatcacaaatttttttttttttgctgaggaagattggccctgagtgaacatctgttgccaatcctcttctttttttttttttttttttttttgctgaggaagactggccctgagctcacatccgtgcccatcttcctctactttatatgtgggacgcctacaacagcatggggtgccatgtccacacccgggatcccaaccagcaaaccactgaagcagaacatgcgccaccagccggccttttttttttttttttttttaacatgtttaaaagtgtgtgtgtcccgggatcaggttcctaaagctgcacagaggacaagcgacacgacgtatttatttcttgagactgttgcctcaaaccgtgtagatggacagaaacgagttctggggcctggatcctgctgggatggggagggggggggagccgtgtagacctgacggctccgtggaacctcccagaactgctgagacgcacaggtttgcaaacccgaaactgtgtcaagcgcggaattccccaaatacaacatcagacagacttcaaagccggcgagtctgcccaccgacaacgggaacggtgttaattagcaacaatgctctttaatctataaataataaagtgatcgcggagctccccggggaggggcaaaaaagaaaaaattaaaaaaaaaaaaaaaaaaaacaggcacgtaaatcagtgcacagactgaggtcagcgcccgagaccaacgctggccgtttcctggaaaccgtttttggcgtttggcagaaagagtccgttttacaaggggaagggggttcccaaattaagatgcgtttgaaggaaatcccccgtcacccctcgatagacctttggggatgagaccccgggggagctgttgggtccttgggccgggggatcctgggaggagccaagcgacctcgctatcagactaaccagaggaaatggccattttgatgtcttgaaaccccccggaaaggacatttttaaaggaaaaaaaaaaaaaggttcgttttaggcagatacaaccatttgacctaataatcagtcaagatttacaagaagcgtttgtgtaaaatgtatgattccatgtgaataaggaacctgtctgttttcactgcttttcatgtcttgtcactgagaacggttttctcctgggaaacgatccacgtattgattgactgacaaaacgtcgtgtgcttttccgtagacccaaagggacattctttctagtcctttctgaacaattgcaaaatctgaaagtgaggtctcaattttagtcttttttttttttttttttttttttgctgaggaagattggccctgagctaacgactgtttccaatcctcctctttttgcttgaggaagactggccctgagctaacatccatgcccatcctcctccactttatatgtgggacgcctaccacagcatggcgggccaagcggtgccatgtccgcacccaggatctgaaccagtgaacctcgggccgccaaagcagaggtaaaggggcacatatgtatggtgatggaccaataataatgtacaactgcaatttcacaatgttataaaccatgatgaccctcctggctcatctgtcctcgaggtgccatgatgttgactctttgccccgtggattctttgtgttttctgagtcaaacgagatctcttccccacagggaatttttccccccagtaattgtatcgaggtcatagtggtcccctcgccttcttcctccccatcgttcgttccaaccgccatgcctggcagccccctgaccacagggcctttgcacagtctttcccgtccttatttattcttattttttttttttttttttgccatatctcctcttacaaggcaggtgctcacactttaggctttgaataagcgattaagtttccatgaggacactttttccctattgaagcctttttctaaataaattttaaaatggctgggtcgcatcccaagccacacgcatgtcgcattcaaacaataaattcgtaaaaccgctgaatgttgctcgtggtgcaaagatagggaagctgccatttttttatttttaaatttttttttcttttttcaaatttttttcccttttttttaaatgctttgattgtgaagaaatcccccttaagctattcaggtcacccgcgatgaatgcggttccccttgttctctgagggaagaaaataaacacggcaagtggggtctgcgtgtgacactgggaggtgagttttttttttgcatctgaaaaacccggggctgaatgtctctctctgagtgaatgaggtgtttaaaaatcatcatttctgtttttcctcgaaaaaaagcaaaagacgtcatcgcgagtctttccaggatcatggttttcaatgcccttcgacggctgggtcctagaaacaaactttttaaaaaaatttttcctactgcgactatgacatgatctcgcgaggttacgttccgggatggtgagacgacccggaattctctcgtccaccccgcaccctctccatcctggaggtctcgcgatgattcctttcaatccagcgggtgctgaacggtctcacgggttgttgattgacaaagtgatcgactcttccaataggatgagaagggctcaccggcaggtgttcacactcgctggcagggatgagtctgcccgttttccccacattcgcattcaagggatgatttctcgcctcccccccggggaccccagaggatccaaaccctccctcgcgctcgccgtttaaatctaacggtccgggaaactggccccgcgggtggttctgagcacctgtggggtgaagggacgacattcctggcggccgccgtccagaatggggttcccgtgggggacccccagctcgggggtcaggagggggtcaggccctccccccgcggtgtcctagcagaaacccctataaggccgagcgactgcttggtccacaccgcgcgtcctcgggaaggatgtcggatggcagtttcgggtcaaacgctttccccaacggctggggcgggaaacgcgaaaaacggtttagttcctggaggatttaatggtttccatctgggtcccttcgcgcgcgggacggccgcctcgtcttcacccgcgtttacccgcgtccgcggcgaatcggagaacgagcgcaggtccggacccgccgcgggtttgtctgcactcgcaagatggacctgagcgttacaagaatccgaatcggtgcttcctcggcggcgctgggcgcgggtgaaggaccccagggtgcggggcgccggcccaaagcactgctgcgaacgaaagacgttccccggggagcgcgggtcccggcgacgggggtgaggatgaggatgaggaggaggaggaggatgaggaggaggaggaggaggaggatgaggaggaggaggaggaggaggatgaggaggaggatgaggaggaggaggaggaggaggaggaggaggaggaggaggaggatggtgatgaggatgaggatgaggatgaggaggaggatgaggaggaggatgaggaggaggaggaggatgaggaggatgaggatgaggatggtgatgaggatgaggatgaggaggaggatgaggaagaggatgaggatgaggatgaggatgaggatgaggaggaggaggaggatgaggaggaggatgaggaggaggatgaggaggaggaagaggatgaggatgaggaagaggatgaggatgaggatgaggatgaggatgaggaagaggatgaggatgaggatgaggatgaggatgaggaagaggatgaggatgaggatgaggaagaggatgaggatgaggatgaggaggaggaggaggatgaggaggaggatgaggaggaggatgaggaggaggaagaggatgaggatgaggaagaggatgaggatgaggatgaggaggaggatgaggaagaggatgaggatgaggatgaggaagaggatgaggatgaggatgaggaggaggaggaggatgaggaggaggatgaggaggaggatgaggaggaggaagaggatgaggatgaggaagaggatgaggatgaggatgaggatgaggatgaggaagaggatgaggaggaggaggaggatgaggatgaggaggaggatgaggatgaggatggtgatgaggatgaggatgaggatgaggatgaggatgaggaagaggatgaggaggaggatgaggaggaggatgaggaggaggatgaggaggaggatgctgatgaggaggaggaggatgaggaggaggaggaggaggaggaggaggaggaggaggaggaggaggaggatgaggatgaggatgaggatgaggatgaggaagaggatgaggaggaggatgaggaggaggatgaggaggatggtgatgaggaggaggaggaggaggaggatgctgatgaggaggaggaggatgaggatgaggaggaggaggaggaggaggaggaggaggaggaggaggaggatggtgatgaggaggaggaggaggaggaggatgctgatgttgatgtggatttggatgcggatgctcctgcagtggttgttaggccggaagtcgtccctctggatgatgcacagccgaccccacgcggagtctctgagccccactttcccccccggccccgtgtccgtggaaacgccttcacccccgtccccccgcggccgcggggaggaaagtcgggcgctcgctgcggggtccccaccgcgtgtccggggtccaggagccgctgccccgctcgtgcccgctcctcggggcccaggccagacccgcggcctccactcgcggccgggtccctcaaaacgttcccgccaagtggtcctgtcgattcccacagatcgacggggttgttcgatgacccctgtctggtctcagggtgattttttttttttgaggaagattggccctgagcgaactgctgccaagcctcatcatttattttttattttttatttttttagagccagaagaaggtaagagacgacctcagcttccttcccgaggaaaacgggcctgtgaatttggggtcagcccctgaccagttttttttttctatttatttttcattgatggcttattacacacggtataaaattcaccatttacagcaaagtgagcaatcgagcggcgtttggtgcgtccacactgctgtcccaccacagcttctgtctcattccagcgcattttcatggcccccgaaaggagaccccaaatcctgtgacagcatctcgggccctggagaccacccacctgccttttgtaagtggctccggatttgcctgttctggacattttgaacagagaggtcatacgctgtgtggccttttgattctgaccttatttctctgcttttcccttcagtttttcaggtcacaggctgtctccattctcagaagattctagaaggttctaggctggcaacccagagggttggcccccaacctggcgcccagcgtcccccggatccgaggagcaggacgtgggatcttaacccgaaaattaaaaagacggctcctgcttttcacagggagacgctttttctgcagaaatatccttatttcgcgacttcattagactgaacccgtggctaaccgtttctgacgatattccaggaaaacggctactctttctatttctacaagtggttgttctttgtgcgcttggttgattgcctaagaaatctcttcgttggataaacaaattgggaagccacgctgtggtgggcgtcccacatagaaagtagaggaagacgggcacgggtgtgagctcagggccagtcttcctcagcaaaaaaaaaaaaaaaaaaagaggaggattagcagcagttagctcagggccagttttcctcagcaaaaaaaaagagagagagagagagagaggaggattagcagcagatagctcagggccagtcttcctcagcaaaaaaaaaaaaaaaaaaaaaaaagaggagaattagcagcagatgttggctcagggccaatcttcctccaaaaaaaaaaaaaaccaaaaaacaaattgtgctgtctctctctctctttttttttttttttttttttttaagaaagtcaacatttttatctttagaaactcaaaccgtttgtcaatagcctaagaggggtttctgggtccgccgtcggagaagccccccccccccaggatggtcctccagcctccccctcctcaggggaacatccgcgggcagggccggcccccccccacccccgacccccgagccgttgcaggggcagcaatttccgagcgtgcaattagaagggccccgagtgcagcggctccgcgaggccccgagcgtgtgcaggcccgcggcccgcccgtaattgcatccagacggtaacctcggggtggcctgtgtcccggcggtgaccccgggcccccgcgcgggcctcccacatatgggacggttttccaggctgattgctgggccctgattaagggatgtggggcggcccctctcgttccaacagctgctccgagcgacgctccccgggaagcgttttctgccggctcggctctcggttccccaaataggaacgaggtgcggccgacgggccatttcgggagggacccccccccaccccccgggggtctcgcttccccgtgttgctcatgacgtgcattacaaaggcgcagattttggaaattctgcgttgcatcgggcgctgacaacctgctcggggcctgtctggagaggtgggtctcgtgcaaatgtcctggggctgcagatggggcagcttgacccgcagacgtgtgtagtcttctggaagctcctgaggggaatctgttaccaggtcggcagggtccggggactccagggtccctgggctggtggccgcctccctcccgtctccacctccgtcctcaggcggctgctcctctgggcacgtctgcgtcccaatttccccttttccttaggacaccagtcctagcggatcaggacccaccccaaggacctcatttggactcgattccctctgcaaagactcggctccccatcgaggcccgtgctaaggtcctggggtgagcgcttcactatgggaaccgggggcggcacgttatgcaggtggatccggctgcggaaacaccccgtctgtcatcagcgggatccccgattccgtgacttgggtccagagaggacagggtttgagaccctgagcttgtctgcccgcgtctccactgcctgctgccgatacgataggaagagtcatgaggtcctgaaaacacggctcacctcatttggggcagattttcctggatcgtccaccccgctgggtttcgtcctcgagatttaagaactcggtgtgacgacagaaaggcttggcggcctcgtcttttaggacacagtgacttttccatatcataaaagagccgactctgttgagttgggaggggaaagaacgtcccttaggtgagccgaggatctctgactgtcgggatttttgtgaccctgacaaatgcacttgctttttttttttttttttttaacacacttctatttaatttaattttttattatggggaaacacgtcgcaaaattatatacagtcaaatgtaacgtgggcccgatggtgtataaaagaaaccataaaatttaccactttaacgatttttaaatgcacagtttggtggaattaagtccattcgcatcgtggtgcagccgtcctcaccatccagctccagaactttccgtcttcccaaagtgaaactcagtccccattaaacacggagtccacatctgctaccccagcccctggacccactgtctactttctatttctatgactctgagtcctggagggacgtcctagaagcagaatcctacaggatttgtccttttgcatccggcgtatatcactgaacatcgtgtcctcaaggtccagccacattggagccggtgtcagactctccttcctttttcagggctgtgtaatattccactgactgcgtggatggagcacattctgtatatccatcatccgtcaccggacacttgggttgcttccacctcttggcgattgtgaataatgctgctatgcacacaggtgtgcaaatacatgttcaaggccctgtctgcaattctttcagctgtgtacccagaagtaagattgctggatcctacagtcactctatgcttaacttttttcgggacctccgtatggcttcccacagtggctgcaccattttacattcccaccagcagcagtgtactgggtgccagtttctccccaccacttacaatttcacttttgacaatagctggcccaatgggagggaggtggtggctcagggtggctttgatttgcgtttctctgacaactaacgatgtcgagcatcatttcagaggctaattggccccttgtgcatcgtcttagaagaaatatctatctgagtcctttgttcctggtcgaaccaggttagttcatgttgttgattttgggaggttctttatatattgtggctattaaccctttatcaaacgctaacttatgaaagacgttatttcactcttgaagtcgtgttttcttggttaagctacaaaaatacgccgccaggcctgactccccaaagcccggaccttcagcatccctctggaccgtcagagaaccaagtgccttcattctaaatgtaagtggatttgtaaggagctgctacctggaaaacgccacagacagaccgtgaccaaaggaagcagggaggtgaggcgacctttattgagtcgtccttgagcctggggccccctgtgcaccatcccctttggtggctcaagggagcaggtccaaatcttcctgttttacagggaaaaacacccgatttgaaaaagctaggcctgcagacgcctgtgatcgcggccaccatcatggctcgtcacaggtgaatcagcattcgccatccagagacgcgcggggttcaagtctggaacaaaatctggcgatgggggtggttctccgtgatgggggccgatgggtggttgggtgacgaatttgtggttttgggtttgcagattgaggctccatccaggggattttcaagggtaagtgttgcctcttggtggctgggtccatataaatggtcaatataggggccagcctggtggcgcagttctgctttgacggcccggggttcatcagttcacatcccgggtgcagacatggcaccgcttgtcaagccatgctgtggcagccatcccacatataaagtagaggaagatgggcacacatggtagctcaaggccagtcttcctcagcaaaaaaaaaaaaaaagagctggaatcttggctcggcctgtgatgtgctctggacaagggtctgaacacagatgcgggacaagtaggaagggaagaacatgtccacaccacagccgggactcgactgaggctgctggggccccaaggcccccacggggagaagcccaagtgaaggggatgagagaccccggagacggggcagtgtgtccaccaggtatgggggtgaggccgtccgggtccatcctgccctgagaggtagatggatagatggatggatggatggatggatggatggatggatggatggatagatggatggatggatggatggatggatggatggatagatggatggatagatggatagatggatggatggatggatggatggatagatggatagatggatggatggatagatggatggatggatggatagatggatggatggatggatggatagatggatggatagatggatggatggatggatggatggatggatggatggatggatagatggatggatggatagatatgcccacgtccacatccccggaaacctccactgggaacttgttcggaaaatgagtgtcgcagtgaaggatctcaatgtaccatggtcctggatcacactggtcctgaatcccaccacagcgttctcatcagagagggaagagcagacgcagacacagaggaacagccatgtgaggacagaggcaaagacaggagggaggtcagcatctcccttctgggacttgaggctgctagtttggggtccgggcggctgcccctttgtccggtggaccagagacatcctgtgctttctgggtgaagagattctcgtgtggttccacgagcccagcgtcccttccacgaaccgaacagccttattggagcaggagggtctggactcaggaccccacgggccgaccccttaaaggggaaacgagtctccaagggctcagggacttgctgggcccccagattcaggaggctgcgtggggtccagtcctcttttctcaggaccccagtggggaccagctggtggcccttcgtggcacctgcctgggtcgtgtccgggacccggcgtggctctccaggcatctgtaggtttccggcccgggttgcatgtgtcccagcacatccctgggcctatcaacaaccatgggaggaattgcaacggggaacccccagcccggctcctgacttcaaagcatggcgggggacactcctggcggccccaagcggccccaggaccttggcatgtgaaacagagtcaccgatgcccctcaggatgctcggaagacccgggaatgctccacgtcctctgtgcaggggccgcggcgtcggatccgggtggaaaagaaactcgttaacacgattgtgatgcacgacggacgggcttctccccgggataaatttaagccaattgaacgtaattgaactcaattgaactcaaagcgagtccgggccgaccttcctcggcggccgtctgctggctgggggggggggggggggggttgtggtgggcggtgcacacggcctcatccggaccatttgcacgtgttgacacggtttgtcatgactctgtctgtgccgcctggaggttgcaggacttgcctggggcctccccgtgaagtcgggggtgtgctgggcgtgccgtgtgcacgtgtgtgtgcatgtgcacgtgtgcacgtctgcgtgcacatgcgcatgccctgtgagtgtgtctgtgcgtgtgcacgggcccgtccatcacgccctgaagttgaggatccggagcggattccggggccggcgtggacgcgtggaaacgaagtttccgggcgggactcgaatttcagacaataaaacgcagagcgttttaggacaagctcatgcacgccatccgtgcggctcgcctgcagatctgcagcccgtgtccggttgcccggaaagaagactgaccagcgctgcaaacaacttttggaggagttgcaacattgttgccaccgaaaccgagaatcgcgtaccaagtgtctatttaccgggtcaggattcgggttgagaggggtgttcagacagggaagatgtgggtcaagtggaaccaggagaccctcctgcaccatttgtcccatttcgggcgggtttgctggggtgtcttggggggcccggcccgcctttgtgaactggcagcacacgagtgtgtaaaaccacatgaggcgtgaccgaattaaagcctgggagtggggtggtggtggtggtgggggaacccggctgtggcggcgagccaggcgcgaggcagccggcgggggccccgaggaccacggttccaattagaggcccggatgacctcatgaggagggtatggcccgaatattaaaaattcctgcagcaaatgaaaggaggctggtctccgggggtggggggccgacaaaggggggtgcaaacatgtttcgttttatttcaacactcagccggctggccgggggaatggaagggagaggaaattgccgggtcctgcccccccgcccacaacccccgtccccgctccatgtttttagtgaaaggcagacagatttacaacacatgggaaaaacaattaggacggggggcccccgccgactacaaagcccgggaataaattcccttaatgagacgggagaagcagagggcaggaaggagctgggagctggcgaccagagaacgaaaatgggaaaaagccacaggtcgcccctgagcttgccccctcggccacagatggcccgcagatcccgcccggcccccattctgcaaggccggggacggctttttttttttttaaaaaaaattttatggggctctccgtggtctggttgtcctcagcaaggtcgcaggaacacacagcaatttgagggctgtcgactgaaaaacataagtggtgagctggacgctgaggacggggcggatggaagtgagaggttgggggggggtctcgaggggcttgttggggtgaccccgatgatgcatttgcctgcacagaggggtgtctctgaaatgcacagctcccgcttggacgtgcattcgaaaacagacgcaaggggaatagtatgcagccaggaaaaaggagtgactccctgacacaggctgcagtgtggaaggaccttgaggatgggatgttccgggagagaactcgacacaaaaggacactggatgtttatctggggtcccgggtaggaaggcgtccgaagtggggagacctgggtccccggcgggaatgcccccagctccaggaggacgacctggggagttgacccttgactggctgagggtcactctgtgcgttgggtggccttccggatcccgagacgaagccacaagtagagacgggaacctgaactcgtttccggggacgggctcatctttttgcgtttattctgttatacgggacgcccagcgagcctggggccagaggtcactgaaggtggtgcctttgacgtgtcaactttcaccggaatagctgtttctagaaatagctcatagccccccacacaggttttggatccgtgggggtggggggggccctgtttgcacccctgagatcgagaagccagtcctggatccgtgatgcttcattgacagatcatcacatcttgaaagtcgtccagaaagtggtggaaaaataagaaccaggtctctggggtttgagagacattttttacaatttaatattttttattgtggttctatatgcacatgatctataacgtatatagaacataaacattgcgtatatatgtaacaataaaggttacatatgtgtatataacataaagattgcatatatataatgtaaacattgcatatgtatgacatgaaggttgcatataaagacaacataaaggttgcatcaatatataggacataaaggttgcgtatataaataacataaagtttgcatggataatgtaaacattgcatatatatacgacacgaagtttgcatatatatataaaacataaggattgcaagaatatatataacataaaggttgcataaatacaatataaaggtggcataaatatatataacataaaggttgcataaata

SEQ ID NO: 114 - DNA, 5100 bp, Equus caballus
ggaggatgaggatgaggaggaggaggagggaggaggaggaggaggaggaggaggaggaggatggtgatgaggaggaggaggaggaggaggatgctgatgttgatgtggatttggatgcggatgctcctgcagtggttgttaggccggaagtcgtccctctggatgatgcacagccgaccccacgcggagtctctgagccccactttcccccccggccccgtgtccgtggaaacgccttcacccccgtccccccgcggccgcggggaggaaagtcgggcgctcgctgcggggtccccaccgcgtgtccggggtccaggagccgctgccccgctcgtgcccgctcctcggggcccaggccagacccgcggcctccactcgcggccgggtccctcaaaacgttcccgccaagtggtcctgtcgattcccacagatcgacggggttgttcgatgacccctgtctggtctcagggtgatttttttttttttgaggaagattggccctgagcgaactgctgccaagcctcatcatttattttttattttttatttttttagagccagaagaaggtaagagacgacctcagcttccttcccgaggaaaacgggcctgtgaatttggggtcagcccctgaccagttttttttttctatttatttttcattgatggcttattacacacggtataaaattcaccatttacagcaaagtgagcaatcgagcggcgtttggtgcgtccacactgctgtcccaccacagcttctgtctcattccagcgcattttcatggcccccgaaaggagaccccaaatcctgtgacagcatctcgggccctggagaccacccacctgccttttgtaagtggctccggatttgcctgttctggacattttgaacagagaggtcatacgctgtgtggccttttgattctgaccttatttctctgcttttcccttcagtttttcaggtcacaggctgtctccattctcagaagattctagaaggttctaggctggcaacccagagggttggcccccaacctggcgcccagcgtcccccggatccgaggagcaggacgtgggatcttaacccgaaaattaaaaagacggctcctgcttttcacagggagacgctttttctgcagaaatatccttatttcgcgacttcattagactgaacccgtggctaaccgtttctgacgatattccaggaaaacggctactctttctatttctacaagtggttgttctttgtgcgcttggttgattgcctaagaaatctcttcgttggataaacaaattgggaagccacgctgtggtgggcgtcccacatagaaagtagaggaagacgggcacgggtgtgagctcagggccagtcttcctcagcaaaaaaaaaaaaaaaaaaagaggaggattagcagcagttagctcagggccagttttcctcagcaaaaaaaaaagagagagagagagagagaggaggattagcagcagatagctcagggccagtcttcctcagcaaaaaaaaaaaaaaaaaaaaaaaagaggagaattagcagcagatgttggctcagggccaatcttcctccaaaaaaaaaaaaaaccaaaaaacaaattgtgctgtctctctctctcttttttttttttttttttttttttaagaaagtcaacatttttatctttagaaactcaaaccgtttgtcaatagcctaagaggggtttctgggtccgccgtcggagaagccccccccccccaggatggtcctccagcctccccctcctcaggggaacatccgcgggcagggccggcccccccccacccccgacccccgagccgttgcaggggcagcaatttccgagcgtgcaattagaagggccccgagtgcagcggctccgcgaggccccgagcgtgtgcaggcccgcggcccgcccgtaattgcatccagacggtaacctcggggtggcctgtgtcccggcggtgaccccgggcccccgcgcgggcctcccacatatgggacggttttccaggctgattgctgggccctgattaagggatgtggggcggcccctctcgttccaacagctgctccgagcgacgctccccgggaagcgttttctgccggctcggctctcggttccccaaataggaacgaggtgcggccgacgggccatttcgggagggacccccccccaccccccgggggtctcgcttccccgtgttgctcatgacgtgcattacaaaggcgcagattttggaaattctgcgttgcatcgggcgctgacaacctgctcggggcctgtctggagaggtgggtctcgtgcaaatgtcctggggctgcagatggggcagcttgacccgcagacgtgtgtagtcttctggaagctcctgaggggaatctgttaccaggtcggcagggtccggggactccagggtccctgggctggtggccgcctccctcccgtctccacctccgtcctcaggcggctgctcctctgggcacgtctgcgtcccaatttccccttttccttaggacaccagtcctagcggatcaggacccaccccaaggacctcatttggactcgattccctctgcaaagactcggctccccatcgaggcccgtgctaaggtcctggggtgagcgcttcactatgggaaccgggggcggcacgttatgcaggtggatccggctgcggaaacaccccgtctgtcatcagcgggatccccgattccgtgacttgggtccagagaggacagggtttgagaccctgagcttgtctgcccgcgtctccactgcctgctgccgatacgataggaagagtcatgaggtcctgaaaacacggctcacctcatttggggcagattttcctggatcgtccaccccgctgggtttcgtcctcgagatttaagaactcggtgtgacgacagaaaggcttggcggcctcgtcttttaggacacagtgacttttccatatcataaaagagccgactctgttgagttgggaggggaaagaacgtcccttaggtgagccgaggatctctgactgtcgggatttttgtgaccctgacaaatgcacttgctttttttttttttttttttaacacacttctatttaatttaattttttattatggggaaacacgtcgcaaaattatatacagtcaaatgtaacgtgggcccgatggtgtataaaagaaaccataaaatttaccactttaacgatttttaaatgcacagtttggtggaattaagtccattcgcatcgtggtgcagccgtcctcaccatccagctccagaactttccgtcttcccaaagtgaaactcagtccccattaaacacggagtccacatctgctaccccagcccctggacccactgtctactttctatttctatgactctgagtcctggagggacgtcctagaagcagaatcctacaggatttgtccttttgcatccggcgtatatcactgaacatcgtgtcctcaaggtccagccacattggagccggtgtcagactctccttcctttttcagggctgtgtaatattccactgactgcgtggatggagcacattctgtatatccatcatccgtcaccggacacttgggttgcttccacctcttggcgattgtgaataatgctgctatgcacacaggtgtgcaaatacatgttcaaggccctgtctgcaattctttcagctgtgtacccagaagtaagattgctggatcctacagtcactctatgcttaacttttttcgggacctccgtatggcttcccacagtggctgcaccattttacattcccaccagcagcagtgtactgggtgccagtttctccccaccacttacaatttcacttttgacaatagctggcccaatgggagggaggtggtggctcagggtggctttgatttgcgtttctctgacaactaacgatgtcgagcatcatttcagaggctaattggccccttgtgcatcgtcttagaagaaatatctatctgagtcctttgttcctggtcgaaccaggttagttcatgttgttgattttgggaggttctttatatattgtggctattaaccctttatcaaacgctaacttatgaaagacgttatttcactcttgaagtcgtgttttcttggttaagctacaaaaatacgccgccaggcctgactccccaaagcccggaccttcagcatccctctggaccgtcagagaaccaagtgccttcattctaaatgtaagtggatttgtaaggagctgctacctggaaaacgccacagacagaccgtgaccaaaggaagcagggaggtgaggcgacctttattgagtcgtccttgagcctggggccccctgtgcaccatcccctttggtggctcaagggagcaggtccaaatcttcctgttttacagggaaaaacacccgatttgaaaaagctaggcctgcagacgcctgtgatcgcggccaccatcatggctcgtcacaggtgaatcagcattcgccatccagagacgcgcggggttcaagtctggaacaaaatctggcgatgggggtggttctccgtgatgggggccgatgggtggttgggtgacgaatttgtggttttgggtttgcagattgaggctccatccaggggattttcaagggtaagtgttgcctcttggtggctgggtccatataaatggtcaatataggggccagcctggtggcgcagttctgctttgacggcccggggttcatcagttcacatcccgggtgcagacatggcaccgcttgtcaagccatgctgtggcagccatcccacatataaagtagaggaagatgggcacacatggtagctcaaggccagtcttcctcagcaaaaaaaaaaaaaaaagagctggaatcttggctcggcctgtgatgtgctctggacaagggtctgaacacagatgcgggacaagtaggaagggaagaacatgtccacaccacagccgggactcgactgaggctgctggggccccaaggcccccacggggagaagcccaagtgaaggggatgagagaccccggagacggggcagtgtgtccaccaggtatgggggtgaggccgtccgggtccatcc

SEQ ID NO: 115 - DNA, 20600 bp, Equus caballus
tgccctgagaggtagatggatagatggatggatggatggatggatggatggatggatggatggatagatggatggatggatggatggatggatggatggatagatggatggatagatggatagatggatggatggatggatggatggatagatggatagatggatggatggatagatggatggatggatggatagatggatggatggatggatagatggatggatagatggatggatggatggatggatggatggatggatggatggatagatggatggatggatagatatgcccacgtccacatccccggaaacctccactgggaacttgttcggaaaatgagtgtcgcagtgaaggatctcaatgtaccatggtcctggatcacactggtcctgaatcccaccacagcgttctcatcagagagggaagagcagacgcagacacagaggaacagccatgtgaggacagaggcaaagacaggagggaggtcagcatctcccttctgggacttgaggctgctagtttggggtccgggcggctgcccctttgtccggtggaccagagacatcctgtgctttctgggtgaagagattctcgtgtggttccacgagcccagcgtcccttccacgaaccgaacagccttattggagcaggagggtctggactcaggaccccacgggccgaccccttaaaggggaaacgagtctccaagggctcagggacttgctgggcccccagattcaggaggctgcgtggggtccagtcctcttttctcaggaccccagtggggaccagctggtggcccttcgtggcacctgcctgggtcgtgtccgggacccggcgtggctctccaggcatctgtaggtttccggcccgggttgcatgtgtcccagcacatccctgggcctatcaacaaccatgggaggaattgcaacggggaacccccagcccggctcctgacttcaaagcatggcgggggacactcctggcggccccaagcggccccaggaccttggcatgtgaaacagagtcaccgatgcccctcaggatgctcggaagacccgggaatgctccacgtcctctgtgcaggggccgcggcgtcggatccgggtggaaaagaaactcgttaacacgattgtgatgcacgacggacgggcttctccccgggataaatttaagccaattgaacgtaattgaactcaattgaactcaaagcgagtccgggccgaccttcctcggcggccgtctgctggctggggggggggggggggggggttgtggtgggcggtgcacacggcctcatccggaccatttgcacgtgttgacacggtttgtcatgactctgtctgtgccgcctggaggttgcaggacttgcctggggcctccccgtgaagtcgggggtgtgctgggcgtgccgtgtgcacgtgtgtgtgcatgtgcacgtgtgcacgtctgcgtgcacatgcgcatgccctgtgagtgtgtctgtgcgtgtgcacgggcccgtccatcacgccctgaagttgaggatccggagcggattccggggccggcgtggacgcgtggaaacgaagtttccgggcgggactcgaatttcagacaataaaacgcagagcgttttaggacaagctcatgcacgccatccgtgcggctcgcctgcagatctgcagcccgtgtccggttgcccggaaagaagactgaccagcgctgcaaacaacttttggaggagttgcaacattgttgccaccgaaaccgagaatcgcgtaccaagtgtctatttaccgggtcaggattcgggttgagaggggtgttcagacagggaagatgtgggtcaagtggaaccaggagaccctcctgcaccatttgtcccatttcgggcgggtttgctggggtgtcttggggggcccggcccgcctttgtgaactggcagcacacgagtgtgtaaaaccacatgaggcgtgaccgaattaaagcctgggagtggggtggtggtggtggtgggggaacccggctgtggcggcgagccaggcgcgaggcagccggcgggggccccgaggaccacggttccaattagaggcccggatgacctcatgaggagggtatggcccgaatattaaaaattcctgcagcaaatgaaaggaggctggtctccgggggtgggggggccgacaaaggggggtgcaaacatgtttcgttttatttcaacactcagccggctggccgggggaatggaagggagaggaaattgccgggtcctgcccccccgcccacaacccccgtccccgctccatgtttttagtgaaaggcagacagatttacaacacatgggaaaaacaattaggacggggggcccccgccgactacaaagcccgggaataaattcccttaatgagacgggagaagcagagggcaggaaggagctgggagctggcgaccagagaacgaaaatgggaaaaagccacaggtcgcccctgagcttgccccctcggccacagatggcccgcagatcccgcccggcccccattctgcaaggccggggacggcttttttttttttttaaaaaaaattttatggggctctccgtggtctggttgtcctcagcaaggtcgcaggaacacacagcaatttgagggctgtcgactgaaaaacataagtggtgagctggacgctgaggacggggcggatggaagtgagaggttgggggggggtctcgaggggcttgttggggtgaccccgatgatgcatttgcctgcacagaggggtgtctctgaaatgcacagctcccgcttggacgtgcattcgaaaacagacgcaaggggaatagtatgcagccaggaaaaaggagtgactccctgacacaggctgcagtgtggaaggaccttgaggatgggatgttccgggagagaactcgacacaaaaggacactggatgtttatctggggtcccgggtaggaaggcgtccgaagtggggagacctgggtccccggcgggaatgcccccagctccaggaggacgacctggggagttgacccttgactggctgagggtcactctgtgcgttgggtggccttccggatcccgagacgaagccacaagtagagacgggaacctgaactcgtttccggggacgggctcatctttttgcgtttattctgttatacgggacgcccagcgagcctggggccagaggtcactgaaggtggtgcctttgacgtgtcaactttcaccggaatagctgtttctagaaatagctcatagccccccacacaggttttggatccgtgggggtggggggggccctgtttgcacccctgagatcgagaagccagtcctggatccgtgatgcttcattgacagatcatcacatcttgaaagtcgtccagaaagtggtggaaaaataagaaccaggtctctggggtttgagagacattttttacaatttaatattttttattgtggttctatatgcacatgatctataacgtatatagaacataaacattgcgtatatatgtaacaataaaggttacatatgtgtatataacataaagattgcatatatataatgtaaacattgcatatgtatgacatgaaggttgcatataaagacaacataaaggttgcatcaatatataggacataaaggttgcgtatataaataacataaagtttgcatggataatgtaaacattgcatatatatacgacacgaagtttgcatatatatataaaacataaggattgcaagaatatatataacataaaggttgcataaatacaatataaaggtggcataaatatatataacataaaggttgcataaatataacatacaggttgcataaatttatatgacataaagcttgcatatatatatgacatgaagtttgcatatatatatataaaacataaggattgcataaatatatatacataagtgttgcatataaatataacataaaggttgcataaatacaacataaaggtggcataaatatatataacataaaggtttcatgtatataacataaagattgcatatacatatgacatgaagtttgcatatatatatataaaaataaggattgcataaatatgtatacataaaggttgcataaatgtaacataaaggttgcatataaatataacataaaagttgcatataaatacaacataaaggttgcataaatataacatacaggttgcatatatatatatatatgtaacaaaggttgcataaatataacataaaggttgcataaatatacaggttgcatatatatatataacataaaagttgcataaataaatataacataaaggttgcatatatataacatacaggttgcatatgtatataacataaagcttgcatatatatctgtataatataaaggttgcataaataaatatacaggttgcatataaatatataagataaaggttgcataaatatatataatataaagcttgcataaatacaacataaaggttgcataaatatatataacataaaggttgcatatatataacataaagcttgcataaatacaacataaaggttgcatatatgtaacataaaggttgcataaatataacataaaggttgcatgtatacaacataaaggttgcataaatataacataaaggttgcatgtatacaacataaaggttgcatatatataacataaagcttgcatgtatataacataaaggttgcatatatataacataaagcttgcatatatatctatataagataaagcttgcatatatatatatatatataacaaagcttgcatgtatataacataaaggttgcgtatctgtaacataaagcttgcatgtatataacataaaggttgcatgtatacaacataaagcttgcatatatacataacgtaaagcttgcatatctgtaacatacaggttgcatgtacacaacatgcatttgccgttccaatcattgtaagggtgcggtcggctttcgtgcaggattttgaggggcagcagggctggtgcagaccccgcttctcttcctctctcctccctccgcccaggagccgggctgtgagcgcgtgcagagggggggctggtggtcgtcctttctccccccgggcggggtcaggaccccaattttcagggccagccgggggccagggcctctgggggaaacgctgtcggaactgctgggaccgcatggtgtgcaccccctggccgcgtttgcaccctgcccgcctcctgcatggacacgcagccccagggaacggctcagggcgcccagtttgcaggccccgggggtgcatccagccgcctgccccgcggacgcccccccccaccccgacgtgcactcctgagcctcgtctgcgtttgaacaaacgcgctttatcctcgaggacgcatttgcaaaggtcaacagaatgcaagtgttggggtcgtgcggtggaaacgcttcgtgtcacagaaggggaaactgaggcctccgagagctgtctggcctccccagcgcccgctgcagccctcaggctcccgtcacttgctgaaagttgttctgcacagagagggtgcgtttcaggggcaggagatgggaaactcagcacagggaagacgtgcagggggcagcggcccggaaggaccagacgccacgtccgccccggccccccctccccagccgagtcgcgcatgcgcttccagcccgcagcagccatgtggggagatacccggatgtggcccggccccagggggtccacaccagagccgggtggtcagggctcctcctggggggtcggtcgcaggggcctccaggctctctagggacgcagaaccggttggatacagatagaactggatgcatgatgggtaaatgatagataggtggatgattgacagatatagattgatggattgatcgatggattgattgatgatagaaaatcagacaggcatagatagatgacagattaatagatagatgatagaatagatagatagatggatggatagatagacagatgcatagacagatagacagatagattgatgatagatagacatagatagatgatagattaatagatgatagatagatatattgatagatgatagatgacagatacatagatagatagacagatagatgtctcagctcaaagactcaggcagacagcgcattctcctttcctccctgtctttgttctattaacaccctcaactgattagacgaggcccacccgcacggaagaaggccacctgcttcactcactctctcaattcagctgctcacctcctgcagagacacccgcatagacgctcccaggatcccgtgtaaccagatatctcgcccccccccccacagcccagtgctgcccggaggggctgggccaggcagaagcggctgccgacgtggggtctgagctgcagggaccagggagcccccagcctcacgttggggacaccgggtgctcccgggccccagagggacgccccgagtcgggacgctcagagacacaagcgggaatggggggggggatgttacggggccccctccccgggcaacgctgacagtttgcttttctgaagtccgttttcaatgggaaaagactggtgtttggggaccggggtgcggcctgaggcaccagacgccccgactctcgcggcccattttcccccagagccggaggccccgttcccagaggctgcagagaccaaagcggcttcgtggatccagaaaatcgtcaggatgctgacagttgttcgctttatccgtttatgtagaatatacggttcgtgcggcgtgagatgcataatatataggagtgtctagaccggggcaaaattgtttaaaattatgtaatatgtgatagtgtataaactacgttgaaatttctaaaattgtacaatatataacagtgtataaaccacgttaacatttttaagcattatataatatgtaactgtatataaaccatgttaaaatttttaagcaatatataatatgtaatagcatataagccatgataaaattgtttaaaattatatatgtgaaagtatataaaccacattaaaatagtttaaagttatataatatgtaatagtatataaaccatgttaatttttaaacattatataatatgtaatagtatataaaccacgttgaaattgtttaaagttatataatatgtgagagtatctaaaccatgttaatttttaaacattatataatatgtaatagtatataaaccatgttaaaatttttaaacattatgtaaaatgtagcagtatataaaccatgttaaaattgtgtaaaattatataatatgtgatagtatgtaagccacgttaaaattgttaaagttatataatatgtaatagtatacaaacgatgttaatttttaaacattatataatacataatagtatataaaccatattaaaattctttaaagttatataatatgtaatcgtatataaaccatgttgaaatttttaaacattacccaacatttaataatatataaaccatgttcaaattgtttaaaattatataatatgtgatagtatataaaccacgttaacattgtttaaaattatataatatgtaacaatctataaacctggttaaaatttttaaaattatataatatgtaacagtatataaaccacttcaaacttttaaaattatataatatgtaacagtatataaaccgtgttaaaattgtttaaattatataatatgtgacagtatataaacctcgttcaaatggtcaaacatcgtataaaatgcaacagtgtctggactcggttcaaatgcgatcatcctgtttcagaaatgggggcgtttcctgtgaaaaaatacgcgtttcccggctgtttccgaggcgtttcccctgaactcccaccgtccttgtcgtgacccctgctcggctctcaggacccgacgtgacccagtaacacggttcgctggggtccccccgaggtggagacgccccctgtccggcccggctctgaacgagtgaacgctcctctgaagcggagacgaaccgttttattatcacgctcggcgcgaacccattatcataacatcgaaaagtcaatcaacaaacccccgtcggtcggttcccggtcagagggctccagactcagcatctcctgctgacgttggaaattaacgcctgacggaggactaaaaaataaaaattctcgagggacgaggcgttttctgggtgggggggacccccgaggcccttaatctgtgctgaattatttcaatctcgtcttggggcctccacgtatccgggcgtccgtgtccgggggctgcacgcgggggcctcgctggcgaataacccgctttttctttccgcggaggaggccgtttttgcagcaaagagcgtttgctgggcgcccacggcgggcgagacggaaatctgagcatcccccttccctctgggtttcctttccaggcacgacccaaaccccagaggggccgtcctcaccaacggcttcacaaaacgtcttcacaaacgcccgcaacgccaggcgcgactgcgtcaccgggtcccaactcggagagtccggcaccaaacgccgcgtgcgttgtgcaaggagcgtgccgtgtgcaactgggacgggcgaacaggggtcaccgaggccgggtcacaccgcccccccaagagactgtgagcgtttctgcttcatcggctggattgagagggtcttaggggtcaagggggcgtcgcccggccctccggggtcccgaagagcaaagtgttgaaatgcgcgtgttgaaacggagtgaatttaacactgagatcgttggggtgaacggggtgttctttcaacacagaatcccactcagggcatcagatgttacctcgaggccaatcttcctcagcaaaaaaaaaaaaaaaagggaccataacaaatgttggagagtttgtagagaaattggaacccccgagtcctaaccctctttgcacacgctctttaggactcttccttcagcccgacgacgtcgacggggtcacgcaggggttatccagacagcatgctttgcctttttcgttcttttttcatgttgtttcatcgagttgtttttttttttttcactttaggaacatgtgttcgcccagctgtgcacaagcctttgacccccaaggggatggatgaaccgtgcacggggtctaaagctgggggatggggttaggggggaaaaaacgcaaaaatagggccctggcaacatggtttgaataaaagaggaggcggaagggactgaggacggtgagaaacgcagcccgtggagggtctcccaggacgcgcgggaacattcaggggggagaaacgatcagcgttttttgcgcgttttcatttgaattttcccttctgaacggggtcccggggtcaggcgaacacgttccagggtgaggtttgcatgcactcgatttcccccccccgagaaagcttcatctggctgcaattgacttgtcgctccgccggccctgctggaatcggccctaagaaaaaattagggtgcgtgtggggggtggtgggggggtcatgcccgtcaaagaaaccgtgtgcgcctctcacttctgaggggagagggggactgctctctctcgggccgttaagggggctctctgcctcagtttaccttttaggatccgtcaataacggcctcttgagggccaggcacccgtgtggggcgtctgtgggggaggaggtactgagaacagcacccaaagtgagggatggaaggtgggccgaggagagggaggagcgagttgggggtcaacggcacctgtcactcaatcccccagaagccccggggctggaatggctcatggggaccccaggttggggccgagagtgggcctgagcgttgggaaggaagcctcgttcatcgcagggtgatttctggggtcgggggaccaagcagtgagcccccagctgccagtaggtccagaaagtggggggacgagtggcttgaccctgaacttggggttgcacagtgagcaacctgggcaaccgctccgtccacgctttgccaggacccagggcttccaggacaaagttcacacccatctaccttttccagagcttttccccggatgtggcctggaacacaccccttcgcgactggggtccgtgagcctatagggtctaagggtggcggctgcaaaaagggccccggatgctgcgtctcgggctggtcgtcaaccttgccttccgctcagttgctattttttctaattctcctccacatccttcatcttttttttttctccgtggaaggcgatgtgcgctttgcgggtagagacgacaccggcttaatttcgggctgcgatccggacctctcccatgaccctgctcgcagcaggttcgtcctgggtccccaggcagatgaattttctgaaatacggaaagcgcgcgtggcaacctcggacgagcacttacggtgcagccgttaatcagtgcatttatttatttatttatttatgtttaaaaaaatttttttgaggaagattggccatgagctaacacctgttgccaatcctcctctattttttttttttttttttttttgctgaggaagactggccctgagctaacatccgtgcccatcttcctctactttacacgtgggacgagtaccacagcatggcttttgccaagcgttgccctgtccacacccgggatccgaacctgcgaacccccaggccgcctaagtggagcatgcgcacttaaccactgcgccaccgggccggcccctaatcagtgcatttaagatgcgctctcggaggctgaaagatacaatgtaactaaaacagccacctgctggttaaacagccggattccaccgaggcgcttaatccttctccagggccgtttgggggccgcgggccccgcacggggagcgtttggagatggcgcctggaggacaggccatcaagcgggtggaaagtcctcaccgtggaaccgaagcgtgtctgttggacgcggcaggcggatccacggggaggaagtgcgcgcggctacactgcgtctccacgcggacgcggggcgtcattgttgccgccggagggttttttctggaggccgtcggaggaggaggaggaggtttttggggctaaaatcaggcgcaagggctgaggctggagatggtcccgagggccgtgacatttgaccccacactgggggcttgaaccccagggatccacccgcccccgtcctggagcccagagtgtgaggtcaagggtcgcagggtggtggagtgagcgggacttgtggggctggaatgcaggccttatcagggccttagggtccccagggcgcctggaacaaaatcctgcaaactgggtagtttgaaccccaggggtccaccctcccccgtcctggagcccggagtctggggtcaagggtcgcagggccacgctccctccggaggctcccggggagggtccctcctgcctcttccagcgtccggggctccagggtccctgggctggtggccgcctccctcccgtctctgcctccatcctcacggggctgctcctctgcgtctgcgtctcctcttctgtctctgaggaggacgctgtccttggattcagggccgcctcctccaggaagccctcctctccatccttgattcagggctgcctcctccaggaagccctcctctccatccttgattcagggccgcctcctccaggaagccctcctctccatccttgattcagggccgcctcctccaggaagccctcctctccatccttgattcagggccgcctcctccaggaagccctgctctccatccttcccttcatcacacctgcaaagaccctgcttccaaataaggtcctgtgcaagggccctggggtcgggacatgaatggcaggtgcacgctgtgcagggcttgaggccacacgggtccccaagatcgcgtcccctacaacacgcttccttcctccccttttccgtgcggctgtagccccgtttatgatgagtcaggagaatcgtgccccaacatcacaaaacgactgcggcggctccggcgagagcagaggaaatgggaaacaggtgcgtgggattagggcccgctcctcaattaccgtccccgccacgggctctccatccagacccgggatttgcgaggcagcctggaagcgggagtgggggggggtggggggggtgcaatttaaggacaaaacagagccctgctttgtgagcctgaggggcccaggggagggaggggatcccaagctctgggccccctggaagctctggatgcacggggtgcaggggcaaagctggcgtctgacattatgccacctctcagatggagcatctacaccctatgggtctacacgggtgacccccgggcacgcagagaagggacaggctggagggaccagcgagaagcatctgcagccgggagcgagggcaaaggtcagcgcaggtggggggacccgacggagagcgaggacttggtgatttcggcacatggggtggaaactgggagcggcgagagtcgatcaagcaccgtccccgtctttgggactagggtgctcgggatgacccaggtttgcaagtctcagctgctggatgtgcatttaaatcagagacgcagggccggcccggtggcaggcgtcctgcatgtaaagtagaggaaggtgggcacggatgtgagctcagggccagtcttcctcagcaaaaaaaaaaaaaaaaacagaaaaagaaagaaaaagaaaagaggaagactggaaatggatgctagctcagggccagacttcctcagcaggaaaaaaaaagaaagaaagaaaagaggaagattggaaatggatgttagctcatggccagtcttcctcagcaaaaaaaaaaaaaaaaaaaaaaaaagaggaagatgggcatggatgtgagttcagggccagttttcctcagcaaaaaaaaaaaaaaagaaagaaagaaagaaaaagaagaggatacgcagcacttagctcagggctaatcttccccaaaaaacaaaaaacaaaaaaagaaaaagaaaagaaaaagaagaaaaatcatcttttgtgcccccagaaaagctcccggcaagatccgctggtttccagcatccgggcatcaagacccgagtcgggatccgtccttgcagcaggattgaaagggacgggctggtctctggggtcaaatttcttgtgggaaatcagcgctccaggaaatgtttgaaatctcccccgaagagttgattgacccacatgcggagcgttccttccccgtgacgtcaagttcctgaagaaacggggaaatcgacccgggaaaacgctctcaatcgggacaattccgtctgtccgtcacccgttaggacgaaaggagaaacccctcgaacacggggcggggggcgcggggtgggctgaaacccacttccgcttggaccgtttttttgtccgttgccaacgtttccacgcgctgagcgttggcacccgcgcaaaccgggttggagacaatgcagttagggttcgtttgatctggtttgaggcgtgttcctaggacccggtggatgaaactcccttgtgttttgtggggccgattaaatagcggctttctccaggagcgtccgtggagggtggtgggcgagtcccgagacacccgcggtctgaacgcccgccgtccgaccatggggttctgggtgcaaacccggtggattctccacgggagcctcctggtgtccaaacggggcgggttcggaccccgcaggggcctcgggtgtcggggagggagcgggtggtgtggacgccgcccccggatctgcagccgcttacggccggggggccgcctcctccctcctgccgcccggcctgcgcgaggaccagcgactgcggcccgggccccgagccgtgtgcaaaacggatggtcaatgcagcaaacgtgcggttgtcgtccgtccacgcagccatccatttgtgcatccacctacccaaccgtccgtccttctatccgccatccatccatccatccatccacccatccatccatctatccatctatcaaccatccacttatcgatccatccacttatcgatccatccacttatccatccatcaaccatccacttatccatccacttatccacccatccacttatccatccatcaaccatccacttatccatccacttatccatccatccacttaaccatccacttatccaaccatccacttatccatccatccatccatccatctatccatccatttatccatccgccatccaccatccacccactcgtccatgcagccttcgctcacaggggtgaaggaatcctgctcgtgttcctcaggaagccccgcccgtgccccgggggttgaccggcgtcctgaacgggaggcccagcaggtgccgtaaagagagacccggggcccagaggggcgtccgcagaggccctgcggaaaagggagcgtcattagagcccagtgtaacctgggtgatcaaaacagggcgtcttggagccggtcgtcaaaccacagcccgaaggacgccgggtccgcgtcccaggcctgaggcccgtctcttgggttcggagacagtcgccgcataatgattgtcggctccctctgcgtttttttcttggctccttgacgagccgggttggcttgcgggccctgtcagggccttgacgggattgagccgggcccgggggtccgcacgctgcctccctccctcgagagggtggaagctctccgtcacaaaagagatgagtcgatttgacaggattgcgggtgacagattctgaatctgtggccggggatggaataactcatttcacccagtggagacgtgttgagactaggatttcgtttcttccaccgagaaatgaacggccggaatccttcggacgggagacgaagccggagctgtcagccaccaggtttaaaaataacactccgacccgggttggggggggggaggatccaggctgttcatcatcgttctgtcctgttcccgtccggctcccgctgtgtgtccacttaagaggatagaattttctttggaagaagcttcctccacaccctccccctcccgatatctctgaaacgaggtcacgctcttccctgggggatgatgtgggtgggcctcgcctaatcagctgaggcgggagaccttgctctaagcggctggggttggtgggcctcacctaatcagttgaggtgggcagcaccgcatctgctcagtcgagatgggtgggccgcatctgatcaattggggtgggtgggccacgtctaatcaacggaggtgagtgggctgcatctgatcaattgaggtggggcggacctcacgtaatcaattgaggtgggtgggcttcatctaatcaatggaggtgggtgggccttctaatcaattgaagtgggtgggcctcatctaatcagctgagatggctgaccttcatctaagcagctggggttggtgggcctcacctaatcagttaaggtgggtgcaccgcatctaatcagtcgagatgggtgggccgcatctagtcaattgaggtgggtgggcctcatctaagcagttggggtgagtggcctgcatctgatcaattggggtggatgggcctcatctaatcacttgaagtgggtggccctcatctaatcagctgagccaggtgaccttcctgtgagctgttggggttggtgggccttacctaatcagttaaggcgggtgccctgcctctagtcagttggggtgggtaggccgcatctaatccttgaggtgggtgggctgcatgtaatcgatggaggtggctgggcctcctctagtcaatggaggtgggtgggcctcatgtcatcagttgatgtgaacggcgtgcatctgatcaaccgaggtgggtgggcctcgtctaatcagttgagggcctggatcgaaacaacaggcggaggaaaggaggactgtttttctctgctcgagccgggacgtccgtcttctcctgcccacccccaccgccccctaccccccccaccccccccccgcccccaccccggcctttggacttggaccgaattccagcccggggtgccctgggtctgcacgccggtgcagagggtggaacggtgctcgtcgtcatgcgagcccgttcctaggaaacgtcctccgactgtgttttcctgtgaagaacccggactcggagcgcggacgtctgaagaatctcaacgaccgggtgctgccgcctccgtgttaacattccgggtgcgtgtcccgaggacgagggatccagccagacgggatcgtgctcctacgaggggcgccccgacccccggcggcctggaagaggcagctccttagggctcggagctgtcctctgtgacctgaggggtcacgacctattcacctgccggggatttttggggtgccgccagtggatgacgtcacgatgcccccatttcgattgccccttgattgactttttgagcacaagtcccactttttgcacaaagcccgtcaattattattattcttttttatttttttgcccccgttctttttctaagcaggcggcctatacggtggggccgtgtgcaaaacatgcccttttcattgacagagaaaaaaaaaaaaaaagagccaccatcaggatccgcggatcgttgactccatttaagcttcttcgtctgcaaactcggctgcaaatctattctattcagatgtgtctgcgtgtggtttttttcttctttttttttttccccctcctcctcctcctcctctgcgcaccccccgaaacaccgacaggaaaaatgaagccagatgaaaatgaagcctcgtgcatgaaatattttcgccccgtgcagccgggatccgggtcctgagctccccgcccggcctcctggccgcataatgagcgcgcggtgggggcctcatccgtcctcacattatttctctctctctctttttttttttttttttttttttgcagcaaatgcatgtccagcgtccatcagccgttggaattaaacgtttcgtcacggggcgttctcatctttttttttttttttgcaccacggggcccgagcaaacgacggcgggacattcatttccctgcaaaaaaaaaaaaaaaaaaaaaaaaaaacgcccagcgtttccgttggaaatgaaaatgcagccgcctgagaagaacatttttctcattcttggaagaggcgggaatggggagccatcgatcaagcggctcccggcgtccgcatttttctcagagcgtctgcaagaaatgagccttttggacttgcaaacttttctttttttttttttttttcctgtatctattttttggggttttttttgttgttgttgttgtttgagtattattattttttttcctgcattgaaactgggcggatgcagaaccccaccccccacccccaaaataattccggcggcgtcgtcaccttaattaactttaacctgcactataaatattaggatggctgacaaggccgcgagcgtttgctcccgcttttgtcccttaaacaatgccagctctgggctcggctccgatttggacttgattagttggaaatcgcctggaaacattttgaattaaattaaaatagcaactgtcacttcctcttcatggattgctgatcgcattccgacttgtaggtttttttttttttttcctccattcccccgccgccccgaataaattagaggagtcgttggcgttgtcaatacaaaaaaaaatttaaaaaaaatggtatcaagaaatgaagagcggggtgaaaataatttaccgttttgggtttaattttagaaactaaagggagaggagagtgacaagcagctgctgcacgtgtttctctcttgtcacgggcgctgtgcgaatacgagcctgggcgtgcgtgtgcgggaccgggtggatgtgggcgtgtgtagacgtgcatggaggggtgcgaacacgcctgggtgtgagcgtgagggcgtgcgtgcgtgtgacttcgtggatgtgtgtgtatgtgggtgtgggaacatgcacctatgtgagtctgcggacatgcatgcatgtgggcgtgcatatatgtgagtctgcggacatgcatgcatgtgggtgtgcatatgtgtgtgaacacgcatgtgtgtgcatgcatgcgtgtgcacgtgcatgcatgtgcatgtagggatgtgcatgtgtgtggacatatgagcacgcttttatgtgaaggtgtgggcatgcatgtatgtgtgtgcctactgtgggtgcaaggacatccatgtgtgtggatgtgcatatatgtgagtgtgtggacatgcaggtacgcgaatgtgtagacgtgcatctatgcaagtgtgtgtgcacatgcatgcacgtgagtgtgcgggcatgcatgagtgtgtgcatgcacgcacgtggatgtgcatatatgtggctgtatgagcatgcatgcacgtggatgtgcacatgtgtgtgtgaacatgcgtgtatgtgaatgtgtgggcgtgcatctatgcaagtgtgtgtgcacatgcatgcatgtgagtgtgtgtgcatgcatgcacgtgggtgtgcatatatgtggctgtatgagcatgcatacacgtggatgtgcatatatgtgagtgtgtgagcatgcatttatgcaagtgtgtgtgcacatgcatgcacgtgagtgtgcgggcatgcgtgtgtgtgcatgcatgcacgtggatgtgcatatatgtgagtgtgtgagcatgcatttatgcaagtgtgtgcacatgcatgcacgtggatgtgcatatatgtggattgtgaacacgcttgtacgtggctgtgcatatacgcgtgtgcacatgcctgtccgtgagcgtgtgcatttgcggcgtgtgtgcatcgggaaggagctgaggaaaagtgggccaagccgcaccccaggagctccttgcaatgtgtgtgcctcggcctcacatggaggctttgctgcgggcgccgctctgtggggtctacacgggcaaaccctcgtcggggtcccacggcggcctcccagacgcaggggaacacggtttggagggacacacagcaagctcctctgttcagggaggttgaccctcggagccttaattttccgggacaggcggcacttggggagaattcagagatttcgaggagttgggctcctcgccgggtgaatgatcaggctgaccctgtccacaacgggtgagccagtgggtctacactgggtgaacccagcccggacccacaaccaggtgggaaaacgacagcccagtattctgtggctcagcggtaaagttcgtatgttccactttggtggccggggatttgtgggttcggatcccgggtgtggacttggcacgccgtgctgtggtagacatcccacatatagagtagaggaagatgggcacgaatgtgaactcagggccagtcttcctcagcaaaaaaaaaaaaaaaaaaaaaaggattggcagcagttcgctcagggccaatcttcctcacaaaaaaaaaaaaaaaaaagaacccacacccgcgagccttccaaggcccaattccacaggcaaacgtcgagtcctccttaagacggagagccgcttccagagtcgagtgcaggccttgctttctgaaccgtggagcctccgtaaagccgcgccgccattcttcctgccttcccgcgtgtctttttttttttttcctctttttcttcctttgtgggtgtcgtcacacacatcaaccccctttgccgttccgggccccggagtcggggacaggaccgtgaggcgccccaggctgtgtggacggcggggtcgcaggccagcgggttctcccgggggtgcggggtgggggggggtccagaggcctcgagccggacacctgtctgcgcgccctcagctccgtgccgccgggttttccaattaggagcagctgacaggtcgtgtcgggcccgcgtgacgggcggtgtggacgggtcgtgtctccaggagtcgagccgcggggacaggagacgggaggccgggctccccccccacccctcgtcttcccagctccctaattgatgaagaaagtgggtcgcccgctcttttttattattttgtctttattttttatttttttttacagaacgggttcgcttttaacgcctcctgaaaaaaaaaaaagacgatttctgcaaatcgggtaattgccggattgactggcctaccttttttttttttttccttcttgagagtctgacctactctctttttttttttttttttttttttccctcctggcttcctttcctggatggaaagacagcgacttcgggaggtgatagacatcacccaattgtgtcagccgcgcgcgtggcattaatgaaacataatggatcttcctggatattaaacagtccacactgggtgggttttttttttttttttttttttgcttttttaatggtcatgaggctgctgggacggcctccaacctcgtccactgatgagggtgggcctcagggggctggtccggagcaaggaggttctgcttccactgcgcacactggttcggtcctgggggtcccagctggaggggggggtccctcctgcctcttccagcgtccggggctccagggtccctgggctggtggc

SEQ ID NO: 116 - DNA, 15900 bp, Equus caballus
ccatccatccatccatccatccatccatctatccatccatttatccatccgccatccaccatccacccactcgtccatgcagccttcgctcacaggggtgaaggaatcctgctcgtgttcctcaggaagccccgcccgtgccccggggttgaccggcgtcctgaacgggaggcccagcaggtgccgtaaagagagacccggggccagaggggcgtccgcagaggccctgcggaaaagggagcgtcattagagcccagtgtaacctgggtgatcaaaacagggcgtcttggagccggtcgtcaaaccacagcccgaaggacgccgggtccgcgtcccaggcctgaggcccgtctcttgggttcggagacagtcgccgcataatgattgtcggctccctctgcgtttttttcttggctccttgacgagccgggttggcttgcgggccctgtcagggccttgacgggattgagccgggcccggggtccgcacgctgcctccctccctcgagagggtggaagctctccgtcacaaaagagatgagtcgatttgacaggattgcgggtgacagattctgaatctgtggccggggatggaataactcatttcacccagtggagacgtgttgagactaggatttcgtttcttccaccgagaaatgaacggccggaatccttcggacgggagacgaagccggagctgtcagccaccaggtttaaaaataacactccgacccgggttgggggggggggaggatccaggctgttcatcatcgttctgtcctgttcccgtccggctcccgctgtgtgtccacttaagaggatagaattttctttggaagaagcttcctccacaccctccccctcccgatatctctgaaacgaggtcacgctcttccctgggggatgatgtgggtgggcctcgcctaatcagctgaggcgggagaccttgctctaagcggctggggttggtgggcctcacctaatcagttgaggtgggcagcaccgcatctgctcagtcgagatgggtgggccgcatctgatcaattggggtgggtgggccacgtctaatcaacggaggtgagtgggctgcatctgatcaattgaggtggggcggacctcacgtaatcaattgaggtgggtgggcttcatctaatcaatggaggtgggtgggccttctaatcaattgaagtgggtgggcctcatctaatcagctgagatggctgaccttcatctaagcagctggggttggtgggcctcacctaatcagttaaggtgggtgcaccgcatctaatcagtcgagatgggtgggccgcatctagtcaattgaggtgggtgggcctcatctaagcagttggggtgagtggcctgcatctgatcaattggggtggatgggcctcatctaatcacttgaagtgggtggccctcatctaatcagctgagccaggtgaccttcctgtgagctgttggggttggtgggccttacctaatcagttaaggcgggtgccctgcctctagtcagttggggtgggtaggccgcatctaatccttgaggtgggtgggctgcatgtaatcgatggaggtggctgggcctcctctagtcaatggaggtgggtgggcctcatgtcatcagttgatgtgaacggcgtgcatctgatcaaccgaggtgggtgggcctcgtctaatcagttgagggcctggatcgaaacaacaggcggaggaaaggaggactgtttttctctgctcgagccgggacgtccgtcttctcctgcccaccccaccgcccctaccccccaccccgcccccaccccggcctttggacttggaccgaattccagcccggggtgccctgggtctgcacgccggtgcagagggtggaacggtgctcgtcgtcatgcgagcccgttcctaggaaacgtcctccgactgtgttttcctgtgaagaacccggactcggagcgcggacgtctgaagaatctcaacgaccgggtgctgccgcctccgtgttaacattccgggtgcgtgtcccgaggacgagggatccagccagacgggatcgtgctcctacgaggggcgcccgacccccggcggcctggaagaggcagctccttagggctcggagctgtcctctgtgacctgaggggtcacgacctattcacctgccggggatttttggggtgccgccagtggatgacgtcacgatgcccccatttcgattgccccttgattgactttttgagcacaagtcccactttttgcacaaagcccgtcaattattattattcttttttatttttttgcccccgttctttttctaagcaggcggcctatacggtggggccgtgtgcaaaacatgcccttttcattgacagagaaaaaaaaaaaaaaagagccaccatcaggatccgcggatcgttgactccatttaagcttcttcgtctgcaaactcggctgcaaatctattctattcagatgtgtctgcgtgtggtttttttcttctttttttttttttccccctcctcctcctcctcctctgcgcaccccccgaaacaccgacaggaaaaatgaagccagatgaaaatgaagcctcgtgcatgaaatattttcgccccgtgcagccgggatccgggtcctgagctccccgcccggcctcctggccgcataatgagcgcgcggtggggcctcatccgtcctcacattatttctctctctctctttttttttttttttttttttgcagcaaatgcatgtccagcgtccatcagccgttggaattaaacgtttcgtcacggggcgttctcatctttttttttttttttgcaccacgggcccggagcaaacgacggcgggacattcatttccctgcaaaaaaaaaaaaaaaaaaaaaaaaaacgcccagcgtttccgttggaaatgaaaatgcagccgcctgagaagaacatttttctcattcttggaagaggcgggaatggggagccatcgatcaagcggctcccggcgtccgcatttttctcagagcgtctgcaagaaatgagccttttggacttgcaaacttttcttttttttttttttttcctgtatctattttttggggtttttttttgtgttgttgttgtttgagtattattattttttttcctgcattgaaactgggcggatgcagaaccccacccccccaccccaaaataattccggcggcgtcgtcaccttaattaactttaacctgcactataaatattaggatggctgacaaggccgcgagcgtttgctcccgcttttgtcccttaaacaatgccagctctgggctcggctccgatttggacttgattagttggaaatcgcctggaaacattttgaattaaattaaaatagcaactgtcacttcctcttcatggattgctgatcgcattccgacttgtaggttttttttttttttcctccattcccccgccgccccgaataaattagaggagtcgttggcgttgtcaatacaaaaaaaaatttaaaaaaaatggtatcaagaaatgaagagcggggtgaaaataatttaccgttttgggtttaattttagaaactaaagggagaggagagtgacaagcagctgctgcacgtgtttctctcttgtcacgggcgctgtgcgaatacgagcctgggcgtgcgtgtgcgggaccgggtggatgtgggcgtgtgtagacgtgcatggaggggtgcgaacacgcctgggtgtgagcgtgagggcgtgcgtgcgtgtgacttcgtggatgtgtgtgtatgtgggtgtgggaacatgcacctatgtgagtctgcggacatgcatgcatgtgggcgtgcatatatgtgagtctgcggacatgcatgcatgtgggtgtgcatatgtgtgtgaacacgcatgtgtgtgcatgcatgcgtgtgcacgtgcatgcatgtgcatgtagggatgtgcatgtgtgtggacatatgagcacgcttttatgtgaaggtgtgggcatgcatgtatgtgtgtgcctactgtgggtgcaaggacatccatgtgtgtggatgtgcatatatgtgagtgtgtggacatgcaggtacgcgaatgtgtagacgtgcatctatgcaagtgtgtgtgcacatgcatgcacgtgagtgtgcgggcatgcatgagtgtgtgcatgcacgcacgtggatgtgcatatatgtggctgtatgagcatgcatgcacgtggatgtgcacatgtgtgtgtgaacatgcgtgtatgtgaatgtgtgggcgtgcatctatgcaagtgtgtgtgcacatgcatgcatgtgagtgtgtgtgcatgcatgcacgtgggtgtgcatatatgtggctgtatgagcatgcatacacgtggatgtgcatatatgtgagtgtgtgagcatgcatttatgcaagtgtgtgtgcacatgcatgcacgtgagtgtgcgggcatgcgtgtgtgtgcatgcatgcacgtggatgtgcatatatgtgagtgtgtgagcatgcatttatgcaagtgtgtgcacatgcatgcacgtggatgtgcatatatgtggattgtgaacacgcttgtacgtggctgtgcatatacgcgtgtgcacatgcctgtccgtgagcgtgtgcatttgcggcgtgtgtgcatcgggaaggagctgaggaaaagtgggccaagccgcaccccaggagctccttgcaatgtgtgtgcctcggcctcacatggaggctttgctgcgggcgccgctctgtggggtctacacgggcaaaccctcgtcggggtcccacggcggcctcccagacgcaggggaacacggtttggagggacacacagcaagctcctctgttcagggaggttgaccctcggagccttaattttccgggacaggcggcacttggggagaattcagagatttcgaggagttgggctcctcgccgggtgaatgatcaggctgaccctgtccacaacgggtgagccagtgggtctacactgggtgaacccagcccggacccacaaccaggtgggaaaacgacagcccagtattctgtggctcagcggtaaagttcgtatgttccactttggtggccggggatttgtgggttcggatcccgggtgtggacttggcacgccgtgctgtggtagacatcccacatatagagtagaggaagatgggcacgaatgtgaactcagggccagtcttcctcagcaaaaaaaaaaaaaaaaaaaaaaggattggcagcagttcgctcagggccaatcttcctcacaaaaaaaaaaaaaaaaaaagaacccacacccgcgagccttccaaggcccatttccacaggcaaacgtcgagtcctccttaagacggagagccgcttccagagtcgagtgcaggccttgctttctgaaccgtggagcctccgtaaagccgcgccgccattcttcctgccttcccgcgtgtctttttttttttttcctctttttcttcctttgtgggtgtcgtcacacacatcaaccccctttgccgttccgggcccggagtcggggacaggaccgtgaggcgccccaggctgtgtggacggcggggtcgcaggccagcgggttctcccgggggtgcggggtgggggggggtccagaggcctcgagccggacacctgtctgcgcgccctcagctccgtgccgccgggttttccaattaggagcagctgacaggtcgtgtcgggcccgcgtgacgggcggtgtggacgggtcgtgtctccaggagtcgagccgcggggacaggagacgggaggccgggctccccccccacccctcgtcttcccagctccctaattgatgaagaaagtgggtcgcccgctcttttttattattttgtctttattttttatttttttttacagaacgggttcgcttttaacgcctcctgaaaaaaaaaaaagacgatttctgcaaatcgggtaattgccggattgactggcctaccttttttttttttttccttcttgagagtctgacctactctcttttttttttttttttttttttccctcctggcttcctttcctggatggaaagacagcgacttcgggaggtgatagacatcacccaattgtgtcagccgcgcgcgtggcattaatgaaacataatggatcttcctggatattaaacagtccacactgggtgggtttttttttttttttttttttttgcttttttaatggtcatgaggctgctgggacggcctccaacctcgtccactgatgagggtgggcctcagggggctggtccggagcaaggaggttctgcttccactgcgcacactggttcggtcctgggggtcccagctggagggggggtcccctcctgcctcttccagcgtccggggctccagggtccctgggctggtggccgcctccctcccgtctctgcctccgtcctcacggggctgctcctctgcgtctgcgtctcctcttctgtctctgatgaggacgctgtccttggattcagggccgccccctccaggaagccctcctctccatccttgattcagggccgcctcctccaggaagccctcctctccatccttgattcagggccgcctcctccaggaagccctcctctccatccttgattcagggccacctcctccagggagtcctgctgtcgatccttgatttaggcccgcctcctccaggaagccctcctctccatccttcccttcatcacgcctgcaaagacactgcttcccaataaggccccgtgcaggggcctggcctgtgtggaggccgaagtccactggggtgctaggtgggaagtgaagatttttgccggcaccggatcactggctggcccacctggggggctgcgggttagaaagcgggggcgcccagaaggaaaccccagtgctgcttcttttgggcacagagagcattatctggggcccaagtgtccgttgctgggtggatggataaatgcaatgtggtccatgcacacagtggaatactatgcagccctgaacaggagtgaagccctgaaacagctacacgtggatggaccttgaatgcacgacgctcagagacagaagccagacacaaaaagacacacagcatgtgatcccatggataggaaatgtccagaacccagaaatccacagacagaaagtgggttattgacgccaggggctgggggctgggggatggcaagtgactcttgataggggcaaagtctccttttggggggatgagaatgttctggatccagagagaggcaaatgcgtgaccttgtgaaggcgccaaacaccactgaattgtgtattttaaaacggccggctttgtggggtgtaaattgcatctcaactaaacaaacaggaagggattttggagtccccacagggcaggcggcggcaggggacgggctggggtcacttgtggaagagaaagacttgtctcctgaagaaccgcccgtctgctgggccatcaggaagatggagggacagcccgcaggaacgggaacccgaaaaacgtgctgaccagaacgagctgcgtcttacctggaaggggaaatctgagacagacgggcgcgtcggaaacggcagacgttctcacgcttgaagcgtcctggaatttggagaaaaaggtgtttggaaaaaaaaaaatttgcacgtgaacgttcctagcagtgttgttcacaccagcccggaaaggtgcagacaggtgttatccggctttgggttgagagctgtgcagcctttttgctcccacgaggggggagctgtttgaaaaccctcgttcccgaggagtttagcagaaagatttggggaggggagaaagcaggcacctgtgttcttattaagcaccttgatcaagccgctcctgaagccaacttagtgaactttgcattacagaagccaacgccttcccttttgctttaacccattaaggttgggctgtctctcgggggtgccctaaaaactgatgcccaccccaccagccttgcttttccaggctttctcacacccccaaaaaaaataccaatttggggacgcagggcgcacgagggccaatctgtccgccagcccagagaggccgtttgtctccgtttctggtggtgagcccagcaggcgccagctggaaacggggaagatctcagggccgcgtcgtttcatttcattccgtgatctctgccagccgccgggagaagaaaggcccgattcacggggagacggcccggcttggaccccccacccggcccggatcctcgggaacacccccaaactgcagccgagtctatgttcaacttgcaaaacggcgagtgaaacttggcggcgaggggtcctgggggcgcagccggacgggcgttccgagccgacacctcgtgcgcacgccccggatgcaggccggaccagggggagagggccctgggttccctccacgcccccgtcccgcgagctgcattaattacaagctccatggggccggcccggtggcacagcggttaagtgcgcacattccgctttcgcgtcccgaggttcgcgggttcggatcccgggtgcggacacggcaccgctcatcaagccatgctgtggcaggcgtcccacatagaaagtagaggaacatgggcgcggaagttagttcagagccagtcttcctcagcaaaaaaaaaaaaaaaaaaaaaaaaagaggaggattgacagcagttagctcaggcctaatcttcctcaaaaaaaaaaaaaaaaaaaaaaaaaggaaaaagctccgtatctgttttctgccggccagttgacgattccgaggagggggggcccggtcctcttgacacgcacagcctggccggccagcaagataaagacagtttaccaaataggaaacgtgcccttttattatctgggtgccctggaattggttttttttttttttttttgccgagggagagagagagaaagggggggggggagaagcgtgtggagtttctccaccaggcaggggggctctggtccttttgcagcccccgatccgggggcgtcatcctaaaaaaaaaatccaatccccaaccatggggggtcatcctaaaaaaaaaatccaactcccaaccctgggggcatcatcctaaaaaaataaaatccaaaccccagatcctgggggtcatcctaaaaaacaaatcgaactcccaaccctgggggttcatcctaaaaaagaaatccagctcccaaccctggggggtcatcctaaaaaaaaaaacccccgaccctggggggtcatcctaaaaaaaaaatccaactcccaaccctgggggcatcatcctaaaaaaataaaatccaaaccccagatcctgggggtcatcctaaaaaagaaatccagctcccaaccctggggggtcatcctaaaaaaaaaatccaacccccgaccctgggggtcatcctaaaaaaaaaccaacccccgaccctggggggtcatcctaaaaaaaaaccaactcccaaccctggggggtcatcccaaaaaaaaatccaactcccaaccctgggggttcatcctaaaaaagaaatccagctcccaaccctggggggtcatcctaaaaaaaaatccaagtcccaaacctgggggggtcatcctaaaaaagaaatccaagtcccaaacctgggggggtcatcctaaaaaaaaatcccaccccagaccctgggggttcatcctaaaaaaaattgaactcccaaccctggggggtcatcctaagaaaaaaatcccacccccgaccctggggggggtcatcctaaaaaaaagaaaatgccccccctgccacccccgtattcgcgggccgcgcgcctgccgtcccgtgaggcctggacgcctggggagcgggcggaggggggcgggttggcgcgggtcgtctccaccgccggccttaaaaagccgtgacaagctgacaggctcccccgttaagtggaaccgacggggccgcgtcagcgcgcggcggccgtgatgggagctggcagcggatccgcggggctgcctgatgcgaagcgatgagtggcgcgggcggccgggtaatcgggtttccgttcctgacgagccccgagcgagcgcagcgccggtggtggtggtggtgctggtggtgttgccctcgcttccacctccgtcatcttggaaacggattgcaaattgcttaaaaaccttccccgcctccccctcacctcccctaaaaaaaaaaaaaaaaaatccagagggatgaatggctgcttattatacgcagcctgcatgcggcttgcaaaaaccctaatgggctcgggtgatgggtttcagatgtggcggggggtgcaggccaatggctggtgtcaccgggttggccaagatttttccttttttttttttttttttcctcccaagaagctggttgcattcatgagggtctgggagcggggcgggtggagctgacctttcccgtctgggacacacgggggccggccgagcccgagggatggggacccggtggcatctgaaggctctgccaagtcgagtcggattcccagagtgtagacgcggccaccacccgccaccccccaacctccatccctttcagtgggtttttctcaatggccccaaatgggctgtttcataggtgagcccgccggggggcccctggaggaggccggaagcaggagggtggccaagggggggccaccgaggggaccccaaccccggggggaggcggcggcggtggtgatgacagccccgggtgagcgcggggacgcaggcgcgagtgcgggggtgaccccgaaacggctggaggaagaaattaacggaaggatttaggcggcttacccggcaggcccggcgtcccgtgtccgggtcgacaccccatccataaagggggagattaaatatgggcctttcacgagcggggcctgctgacaaccgtgagggatgggatgtggggacccgggccaggccggcgggggaaacggcggagggaggccgccgtggggagaccacagggcctttgcacgaggaggcccgaacaacgggatgacggccaaggacaaggatggaggtgacagttatcctccatatgcaaacatgcgcacacagggggcgtccccgtcaccccccacccaccccggggccagctgcgtggtccctgcctcgtcctcgtggccccaggacctttgcaggaggaagcacctgtgcggggccgcgtctgcccagctgcgtccccgcctccccgcgcgcggcctctggggtcgcccaggccaacaggtgtttttcctcagaacggggcattcccgggtcccggggtcagaggtcccacgcagccggccccccctccgcccccgggagcccgccgggctgcaccagctgtttaatattatcagagctcgtcggccgccgcggggatggacgggggggggggttgtcggcggggccccaaataaatttcaggggagcgcctttcaaagccgggcctattagggcgtctgcgcaatggacgacccggttcacggtaattcgaggaggcaggcggaccccccccccacccgtccccgtccccgagccaacacatgccgtcctctctcgcctggccccatgggcggtaatttcggggtctcatttccatttgtgagaaaagatcccctacttccatatggaagcaataaatacgagaaagtcattaaaatttctctaatttagaaagagggaaaaaaaaaaaaaaggaaaaaaaaaaagaaaaaaagaaaaaagccctaatgaagtaatatctttgccagaacaggcagaaatgtaaattagacgttggaaggaaaactattaaatgcgtggcgagctcgctggcctctctcgctctttttttttttttttttttttttgggcttaaatctaatgaatttatgaattgttggttgttgggtcacagactttgttcatttcctactcgttgggctcagcgggggtttggggttggggggcgacgcgggacggcgtccctaccccccacccccccaccccgaggacccgcgaatggggagtccattagcggggtctcgctaatcgcgaccccagtcaccacggcggcggcgggctgggattaagaagcgaggggttgcagagtgactgcgtgatgcccagggtggtggcggcctcagagcagagggaaatgaggaactgagtgcaaatcggattctgccgtccccgcgaggccacctccagccgcccgggggcccgtggggatcggcgaggccctggtcccggaccagagacgtctgagcccggcgcccctcgtgcaaccagctggagcgacactgtggggtcggaaggtgtccggtcgtcgtgggggtggcagcgttcaccaccgtgtccccctccgagggcgcccagcaggggtgtcccaagcgcccagagactctgctgacctcccggcgaccaggggagcccagcagcgcagcgggctggggccgcgggctctggctgccttcgagctcctccagggacccattgcccactcgttgcacggtggacccatcttctagtcactctacagttgacccatcttctagtcactctacagttgacccatcttctagtcactctacagttgacccatcgcccagtcactgcacagttgacccatcgcccactcgttgcacggttgacccatcacctagtcactctacagttgacccatcttctagtcgctctacagttgacccatcgcccagtcactgcacagttgacccatcgcccactcattgcacggtggacccatcacctagtcactctacagttgacccatcttctagtcactctacagttgacccatcgtccagtcactgcacaggtgacccatcttctagtcactctacagttgacccatcgcccagtcactctacagatgacccatcgcccagtcactctacagttgacccatcttctagtcactctacagttgacccatcgcccagtcactctacagttgacccatcttctagtcactctacagttgacccatcgcccagtcactctacagttgacccatcgcccagtcactctacagttgacccatcttctagtcactctacagttgacccatcttctagtcactctacagttgacccatcttctagtcactctacagttgacccatcgcccagtcactgcacagttgacccatcttctagtcactctacagttgacccatcttctagtcactctacagttgacccatcgcccagtcactctacagttgacccatcgtccagccattgcacacttgacccatcgcccagtcactgcacagttgacccatcttctagtcactctaccgttgacccatcacccagtcattgcacggttgacccatcgcccagccgttgcacatgggtcaacagggtcaaagctttcactaaaagttcctcctgaaaataagaaggcactctggtcgtacaaatggccatgggctgaatcatgtcccgacccccaaactcacgtgttggagtcctgaccccaggaccttggcacatgccgggatttggagacgggtctttaaggaggggatggcggtcaaatgaggtcatgggggtgggtcctgatgcaccaggactggggtcctgatgggaagagatgatacacgcacagagggacgaccacgtgaggacacggggagaagacgcgtctacacggcaaggagggaggcctcaggaggatccagccctgcctgcatttggatcccagacgtgcagcctccaggaccatgagtccattgacgtcagtggtgttagccgccccgtgtggggaatttgcggtgatggccccagaaaagccatacaatcctcgtatatcagccattctccttgtcctttgggccttgcaaagtgggttcttcctcctgagctttattttgcgcccccaccccccccgaggacttgaaatgaggatctcaaaggggtccccgtacccccatgttcacatcaccaagatacggaaacaacccaagtgtcgatcgatggacgaacgaaaacagagaatgcgatccatcggtgcaacggaatattactcagccctgaaaaaggaaattcggccgcacgccggggggggcgggaaatgggagcatccgtccagttcttccttgcgatgggcgatcccgagggctgtccggctcgtccctctgcacccggaccgctctgtgacatgtcctctcccgccgtggggcgcgtcatccagcttcgggcaccccggaaaacacgcgggaagccagcttgctgtctggcttttgtgcaaggacgatgcaggttttggccgagcgaggttttccccgtcactctgggctggcgaatgtcaccccgtcccatccgggggacgggaaaaatctaggacccggcggccggtcgggccggtgacgtgtgcaaaggaggcaggaggaggccgaggtggaaaaatccaccgcagacggtggtgggttttacgggccgcaccgcagcgggtgtaaatggaaacgcctgggtgggttggtggcaatgaaacggtttatagacccccggcggctgttccctcttaggcgtcttattaaagtgacggccccgtaaacagagaggttgtaaacctgccggaccccagcaccaattaaaataataaaaagccaggagggagaggggggggggggcctccgagcgaagcgggtttggcaaaggatcctggaggcccgcggaggggagggggccggcccgaacgggatccgccaagaggagggaggaaggagagggagcccaggacggggtgaggaaaaggagggctctggtgtggccttcaaggcctgggtggagacggagatacgggaaagctccggggcggcctgacaatcttgaaatgcagggaactcaatgtctaagtggatgatatggggggcattttgctgacctttcacccctgctggaccgggtccccgagggtcagcgagtgaacttcttgtaatattttttcaatcaacaaaccatgtcttccgtaataagaccaaacacaccccaaagttagctaagctgcttcccctcttcctccattttctgagaccacttgcacgggttgtgcgaatggctgctgtccacagagatttggcagaagtttctccttggaatcaccatcaggttctggtttttgaaatttttttatatttttttttttgtaaagaagattggccgtgaggtaacatctgctgtcaaccctcctcctcttttttttttctcttttttttttgctgagaaagactggccctgagctaacatctgctgccaatccttcccttttttttttttttttttttgctgaggaagagtggccctgagttaacatctgctgtcaatcctcctctctctctctctgttttttttttttttttttactgatgaagactggccctgagctcacatccgtgcccatcttcctctactttatacataggactcctaccacagcgtggcatgccaagcggtgccatgcccacacccgggatccaaactggcgaaccctgggccgccgaagtggaatgtgcacacttaaccgctgtgcccccggccggcccgggtgctggtcttcgagggctcatcttttcttgcaatttccgtctgtaaattttcaggttggggtcggcattttctgcgtcttcctggactgagttggcagagtccgtgtttccaggaaactgcagcgtttgggggacgaaccgtgtaaacgctgctgctttccgcagacgctgaattgctcgctgtcgttcaggtctgagggataattggttttctttacaattctgtttttaacagaaaggtcgttgggttcaagtaccaaatatttgggatttttaaactctcttctactcagttcagaaatctcagtttatatcacgtggatcctggaaaagagacggagttttgtttcgtgtttgaattccctatgaagatcctctcc

SEQ ID NO: 117 - DNA, 59600 bp, Equus caballus
ctgcaaggtttcacatttctgccgggtcagtggaaataggagctcgggcatcaagtttattttttttctctctttttttttttctgaggaagattggccctgaactaaccactaccaatcctcctgggttttttttttttttttctgctgaggaagattagccctgagctaacatctgctgtcaatctgcctcttttttctttgtttcttttttctttttttgctgaggaagattggccctgagctaacatctgctgccaatgctcctctttctttctttctttttttatttttgctgaggaagactggccctgagctaacatccgtgcccatcttcctctactttctatgtgggatgcctaccacagcatggattttgccaagcggtgccatgtctacacccgggatccgaaccagggaaccccgttaaccactgcaccaccgggccggccccccgtcttaagcatttttaagggcacagttcgggggcgtgaggcacgttcacgaggttggggagccgtcccccccatctgcctccggaagcttgcgtcttcccgacctgaagctctgaccccacgaaaccccgactccccgtcgcctcccaccgcccctgctccatggtccacacggtctgtgtctctgggttttcgactctggggacctcgtaggaggggcgccacccgggtcccacgtacaaagtcgaggaagatgggcacggatcggagctcagggccactcttcctcagcaaaaaaaaaaaaaagaggaggattggcagcagatgttcgctcagggccactcttcctcagaaaaaaaaaaagaaaaaaaaaaagaacagcatggtccagcgttcgttcattttctccagctcgggcacaatgaggtgttgttccaatcctcagttctttctcttccgcccgagaagagaggccaggcttagtttttattacccggcccataaatcaccgtttccttcgcggcctcgacccccgagcgctgcacacgtccctctctccgcctgtcggctcccgactcgaccagccgcctcgaaatcctcttaagtcccagagcagctgctaataggatcccggggacccggacccgccgcccagcacctgtgtttgtcatcacagggcccggagtctctgttccgaccgctcggcggggtcggctatgctggatgcttgattgaatttttcctgcgggatttgagtggctacttgatggtctttttttttttttcctccttggacattctgccgtttgttggacgcggggtggaaacggagacctgttggcacaaatccccttttgcaaagaggccgacggaaaggggagaagacggttgctttctgaatgggggtaaaaaaaaacaactagagatgcggggccagtcttcctcagcaaaaataggaggataggcagcacttagctcagggctaatcttcctcaaaagaaaaaaaagaaaactggagatgaagagagctcaaagacttagtcatgtcaaaatctcaggtgtccatggctgtgttgggatcataaaggtgcttttttttaccttttttttttttttttttttgctgaggaagactggccctgagctggcatctgctgccaatcctcctcctctttttttttttttttttttgctgaggaagactggccctgagctaccattcgtgtctgtccacacccgggatccgaaccatcaaacttcaggccaggatggatctctgatgttttaagcccccagtctggggtcaaatgtcacgcccctaggaccctcctaaaagctgcccctcccctgcatggtgtctcccacctgccggctctgacgaccccgtgtgggcaggacaccgaggtcaccctcaccacggcctgagtcgggttttttccacccgggtcagagggggccgtgtgcattttggacgttggacgggggcaaaggtgacatctggatggaacagactttggggccgggcctggcaacactcctcgtccaatcggggtgccgggcggaggaggggagctgagccaggaggccgtttcctgcgcaaacggaacggggtggagatcaggcccgggggtcaacagtagaacgcgggaggaagagctcagcctggtttcctctggacgatccaggtgagccgggaggggtcaggcgaatggggctctgcagggtgaataggagtttgccagcccgccggacagtttggggctaacagcgacagattttctgaagtaggaatgaaaaggaggtgttcccttttctcctaacctgccaggagccccctgaagcctgagcccgtctcatggtggtggtggtgctggtggtggggctggtggtagtttttttaattcgtcttcaggggccctggaactcgagttgggagccgagatgcccttttcagccccatttgagcggcaaaaaattttaaaaagaaagaattgtgggtcagacaagggctggggaaggcgcatgagtgagctccccggctcacggccggggtcacgcccgtcggtgccgccatattggaaaccattgggcctcacctggcgcaggtgagcggggcctccagacccccctccaggttgactgagcccggctcgcgccgcctcactaggtggtttcgggcccggggttaagtcatttccgcctccttcccgccaaggggaacggggtttaattcacgggcgttgttccaagcgttttaaacgttttatgggcggcttgtaaacgttttatttaatggccctgacccgcgagaacacagtaaacctgagccaggccagctttcagggcatcggagggtgcgactgtggggggtgaaggccgaccggagagtttgtggggtcccagcccgttcgcatagaggggtcaagccatcaaaggtcagatgttgtgcccagcctagtataaaaagcagaggaagatgggcaaggatgttagctcagggtcagtcttcctcagcaaaaaaaaaaaaaaaaaaagaggaggattgtcttcctcagcaaaaaaaaaaaaacaaacacgaggaggattggcagcagatgttagcccagggccaatcttcctcaagaaaaaaagagaaaaaaaaaaaaccccaccacctgcctctacacagcgcccggtgtattatgtatctgatgatgtgccaaatacgtaacaaagaagatattacgagtcaatgaggagtcaacacaaagcgcacaccccaggctaacggtggcgaccgtttggagcgtttataacggccagcgttgccgaggacgtggagcagccggaagtgaggtgggcggcccgggcgcaaacgcaaaatggcgcagaccgttttggaaaaacggtttgacggcttctcggcaagcgggaacgtccagcgtcccatggagccgttttccactaacgtgtccacgcagctggaaggagacggaaaatgcacaagcctgcaattgggttggggggaaacgggtaggcaagtggaataaggactttggaggcgtgtgtggagtcagaataacccgcatctgatcgtgcagtgattgcacggctgcgagtcttcgtccaaacggcccccgttgcctgttttcaaacggggcacagacggctgcaaaccgtatacaccgccgccaagtgggttaagaggtttcgaagtgcaagcagcttggggtccgccgggcggcgtgtgtggaatgcaatccttttctgcataaacggtctacacccggggagctgggagccgactcacagacacgactccgggacccggacgtgccctgtgcccgacagcgcatgcgcggtgcatcctctctgcatgcgccggttccccccgcagctgacctgccgggtccccgctgcctgcgagcccggaactcgggtcagacccgggttcgtctacgccgcggaggtttctgcagcggctgcacacgtccctccccaggtgggcccggccgtgacctgtgccctttgccctttgcaccaacgcgctaacgagggggctcgtttgcaggacgtgcccgagctgccaagcgagccgagcgctgcagccgcagagatgaaccagaggtttattagccgctttgcaagcaccgggggatcattcgtgtcgccgccacccgcgcgctttctggggtcctgggcccccgttaggccatgcgttcctgacaacgggcgtgtctacaccggtccgacccgaggggaagtgttgttcctgtgagtcctgtttctttccaagcagatatggatatcgtgcctgattttatcttgctctttttttttttttttgctgaggaagattggccctgagctaacatctgctgtcagtcatcctctttttttgttttgttttgttttgccgagttttttgtttgccggttttgccgagttcttttcccctgggttcaagcagtcgatggtcatggccggagagacaaagcccgggcgcccgacacctgctggactctcactttgtggggcagaaggagggggtggcgagagtggagccctcacaaaacccgtttcattacttcctcccctcgccttgatccagccatgcctgcagtccacctctcaccgctcagccgtaggggaagccgtcagagtcgggagcctccgtgcgcgtctgctcgggggggacgcgggaagcaggacgtgacccgggtgaatcttgcaaacatttgctcctggaaaagaagccagacacagaaggacgcacagcgcgtgattccgtttacgggaaacgtccggaacaggcagacccacagacagaaatgggatgagtggtttcaggggctggtcacggggtcagtcaacaaaccttttaggttccacgcttgggagcaggttcgaggcggccgtttctgtctcccccgtcctggcagggctcgcggtgggggttcgcgctccgaggccgggcgagcggcacacacactgttcccgttttcttgtcatccgccccccctccaccccgccccgccgtctacacagatttaatggccttgttagggccgagccaaatcgggtccttatgaaaccacttacagagcggctttgtggggcccgcttggcaacaaggagaaaaagggtttgggtcccgacgggccatctgctccttgttagcacgttgcctgagtgcggctctgttttcattaaacgcctgggctaacgcgcccggtttttttttcttcttcttcttcttctttttaacgtttgagcaaaaatgtcggacttgaactgcaaatcaccgccaggaagagacggccgatctggatttttttaagtccctgccccgcgcgcacgatgctgttcatctccgcgtgggccatcttgctgtgggatgcagcgtaaggagagaggaggctgggtttttatccctttttcttcttgaggaagattggccctgagctaacatctgctgccaatcctccttttttttttttaatcttttttttgctgaggaagactggccctgagtgaccatccatgcccatcttcctctactttatatgtaggacgcctgccatggcttgctgagtggtgccatgtccacacctgggatccatagactcaggatccatagggttggaatgtgtagacatgggacccaccgtgttgggctccacaggactgacacccacagagtggggatctgcagagctggattcatggggttggaatctttacggttgaacccataggatcaggattcgtagggttgggacccaaagaactaacgtccaaagagttggaatccatagagacgggatccgcagagttgggatgtgtgtggacgggacccatcgtgttgggttgcagagggctgaggtccacagggctcagttcctacagcgaggatccacaggaggaggctcgttgaggtttccacccacacttgggacccagaggattgggatatatcgcgtggggtccaaaggactggatgatctgtctacaccatcggaatgacaggtgtttcgagagcgtcctcctgaagaaagtggcgcttctgttttctgaatgttgcttttcaacatcttcccccaaactgtggccccatgagggaccctcgccctgaatggccaatgacgccattgttgtcaaacgcccatgacctcattgttgtcaatgacccatgacctcattgttgtcaaacgcccatgacctcattgtcgtcaatgacccatgacctcattgttgtcaaacgcccatgacctcattgttgtcaatgacccatgacctcattgttgtcaaacgcccatgacctcattgttgtcaatgaccaatgacctcattgttgtcaatgaccaatgacctcattgttgtcaaacgcccatgacctcattgttgtcaatgacccatgacctcattgttgtcaatgacccatgacctcattgttgtcaaacgcccatgacctcattgttgtcaaacgcccatgacctcattgttgtcaatgacccatgacctcattgttgtcaatgacccatgacctcattgtcgtcaagtgccaatgacctcattgtcgtcaaatgccgatgacctcattgttgtcaagcgccaatggcctcattgttgtcaataaccaatggcctcattgttgtcaatgaccaatgacgtctttatcctcctctccaaagcactcctctcaggctgtatctttctcaaccttccccgtcagtcattcaacaaacatttacgcatcggatgaccttgtgtggaccaggcctccttctcggccctggagccaatcaacagtccttgctaaagtcctgttgcatctggatttacagacacgaataaggaggccccactgcaaacatctttatgggtcggcttctaggtaccaggcacccttttagggtcttgctcatgttcgtgacccgctcgacgacccttgccgagctgacattcgaggccgtaggacagaaatggatccagagactggatttccaggtagaaggtaacgtggcccatggaggggaaaaaaaataatggaggacgcggaaggtcaagagtgttggagcaggaagtgggtagacacgtccaatggggccgtcaggatgggcttcacggggaaggcgagattggagggaagagtggacggaggtgaaggcgtgggccgcaaatgtgggatggcgggagcggtcctcaccccatctactcgtctgtctgtctcattgcaccttcccaacccgctgacgcccaggaccagagccgggatctggagacgggcccaccctcctcaccccgtgaggctggatccccacatgcatacagagagcagatttatcccacagccccgtcccagctcctgcactcgcggggacgtctcattgttcttcggtttgtgcaattttgttggtgatccccctgccctggaaggtgagctccaagagggcagcgcctggaatcctgtctctgtgcttggagtatgcgtggtacacagacggggcccagtaaatgtgtgttgggtggatggatggatgatggatggatggatgatggatggatggatggatgatggatggatgatggatggatggatggatagatggatggatgaacggatggtggatggatgggtggatggatggatggatgattgatggatggatgatggatggatggatgatggatgatggatggatggatgattgatggatggatgatggatgatggatggatgatggatggatgatggatggatggatggatggatgattgatggatggatgatggatgatggatggatgatggatgatggatggatggatgattgatggatggatggatggatgattgatggatggatgatggatgatggatggatgatggatgatggatggatggatgattgatggatggatgatggatgatggatggatggatggatagatggatggatgatggatgacggatggatgatggatggatgatggatggatggatggatgattgatggatggatgatggatgatggatggattgatggaggatggatgggtggatggatagatggatggatgatggatgacggatggatgatggatggatgatggatgacggatggatgatggatggatgatggatggatggatggatggatgattgatggatggatgatggatgatggatggatgatggatggatggatagatggatggatgatggatggatgatggatggatggatggatggatgattgatggatggatgatggatggatgatggatgacggatggatgatggatggatgatggatggatggatggatggatgattgatggatggatgatggatgatggatggatgatggatgatggatggatggatgattgatggatggatagatagatggatggatggatgatggatgatggatggatggatggatgatggatggatgatggatggatgatggatggatgattgatggatggatgatggatgatggatggatgatggatggatgatggatgacggatggatgatggatggatgatggatggatggatggatgattgatggatggatgatggatgatggatggatgatggatgatggatggatggatgattgatggatggatggatggatgatggatggatgatggatgatggatggatggatggatgatggatggatgatggatgacggatggatgatggatggatgatggatggatggatggatggatgattgatggatggatgatggatgatggatggattgatggaggatggatgggtggatggatagatggatggatgatggatgacggatggatggatggatggatgattgatggatggatgatggatgatggatggatgatggatggatgatggatgacggatggatgatggatggatggatggatggatgattgatggatggatgatggatgatggatggatgatggatgatggatggatggatgattgatggatggatggatggatgatggatggatgatggatgatggatggatggatggatagatggatggatggatggatggatggatgattgatggatggatgatggatgatggatggatgatggatggatggatgattgatggatgatggatggatggatggatggatggatgatggatggatggatggatggatggatagatggatggatagatggatgacggatggatgatggatggatgatggatggatggatggatggatgattgatggatggatgatggatgatggatggatgatggatggatgatggatgacggatggatgatggatggatgatggatggatggatggatggatgattgatggatggatgatggatgatggatggatgatggatgatggatggatggatgattgatggatggatagatagatggatggatggatgatggatgatggatgatggatggatggatgatggatgggtgatggatggattgatggagcatggatgggtggatgagtgagtggatggatgtccggctcgatggaagggtagtgggtgggtcgatggacatgggggtgacgggtgggtagatgggtgggtggatgagcctgttctcttccttctccgttaaccggaagctgcccaggtccctcgggtgtggccccttcttccatcttcctgggcagcagcgtcccctcctctttctccctcgtggcctctgctcgtcccctcgtctcctcctctgaccccgctcctcccgccgcgtctgctcagcaccctggtgcttgcgttcaggtcccacccagacgtccccgcatcgggaccccatctcaagacccttaactgcatcccgtccaccaagtcccttgggccacgggcatgtctgcgtccccccgaactcctacgtggacgcccggagcccctataagaccggacgaggacgcggggccctggggaggtcacgaggtgtagacgaggccacgaggggacgggatgcgggtccttccaggaagaggaggaagagcagagttcatcgtctgaggtgaggacccagggcgacgacggccgtccataacctgacctttgaccttcggctcccagcctctggggtcgtgtctgctctcgaaggccctgaatctggggtattttgtcctcgccgggtccgcgtcctgacagcctaccagcttattcctggattggcccgggcgtccattcactgacattcagtcaactatccatgagcactgttgacctttgccccagggaggccgtcccccgtgaccccaaccatctctctgtctgtcacaggctcggtgaagacagcgtgtcccccgccgggctggggtaacgaggccggagttgggggggggagacttggcgtgacagccggcgcccgggcccaggcgggaggcccaaggcgtccgtcctgcgtctgcagagtcgacaccaagtcaactgagccgcgcgtcgagacgtttgcacccggcactcacccgcggcaattttttattttttcgtttttaagaggccggagtgacgggccgttaagggcctcatcgacacgcacaggcccggctgctcattatcggggtccctgtcacgtcaggtgcagaagacggaggcctgcgtggcgggggtgtggggcgacgggcacacggggcctgcatcccgggtggggtcaggaccaccgcccgcagccttggtgacctggcatcctcagattcaggggggccccagccccacaggctcagggggccgggtgcgcacagccctaggtttgctgattgactctgcgacggcggggagcgaggggaggcaggtggaggtgaggtctcctgacatcgttttgccccccccccccccccccacgttgggaggctgggttgcgagcgggcctcacgtcgcgaaatgccagcttgtcaggctcatcaggctccgggaaggggaggcgaaggggctttgtcaacgctacccccagagtcaattaaaatacagcgaggctgacatctgcagaatacccgatgatcaaagccgaaaatgcccatacagcttccgacataaaaacacggtgtttggcgccagactgacacagcggaacaggtcaggtaattatgaggaaatctatgatatagctgttgcaattgcttatcttgttcccattatcacagccatcaaacacaccggcgggctcgctggctgccggatccgaaagccgggtgacacccgcgcagcgcggctgatacagacggcatctcccgagcgactgaattaatttgacagtcaataggcaacagcggttaccggcttgtttaaatatatattttttaattgccttgggacgggggactgggagcggggggaggtggtggtggtggtggtggtggggtgggtgggtggtggtggtggtgggggggtgtgttttcacccttctgggaatagcccggagcgctctcgctgagcttcccagccgcgcgcgcccctcctcccgcccgcgtctcagcattcgcgagcgcgcgcattcgcgagcgcgcgcattcgcggccacgctgcggaactgcggcgcaggctcgttgcacgtgcgcgcgcgtggggggcgttcggctgtcgttggatcgttttgcatggtaattactctgcagaaacacatacatctatttttttttttcccttctccctccaaccccgacccccagcgcccaacacgtgcattaattaccatggtgaaggcactctcccatcttttggcctggatgtgtttattcaattaaggaaagatgtgacagatgaatctgtgcgctcggggggttggggagggggtgtgggggcagcggggcgagaccggggggtggttgtgggggggggtgtgtttcagccggctgggtattttctgccgcgctcacgtcgtaattggcttaatggattctccgcgaggctccttgccctcctctctccagcaaactaattagagctttttacattaaatcctaataggtttcaatttatcgtctctaaatcatcgccatgatcgcagtcatcaattaggcccagagacgccgttcgtcaacaaacgctctgcgtttatatggccggggcgccttctattcccttttaatggcctcccattatcctgcggagggaaaagcagccggccctccagcgcccgtcatcaagcagtcagtcagcaacaacaggccgcctgtgaagtcgggggcccattccaaccgtcagaggtttggacaggcgggttcttcattttttaaaaaattttttatgtttttattttttaaaaggtaactaggaactttcagactagcttttgcgggtctggaggtgacgggctcatgtggttttgtgcagaaaaaaatagcagaagggcgcgaggcgagaggctgggagtgcaacccggtttcttcagctcgttaggagggcgacggtgtccgttaaatcgtatttttgagggtctttttattttattctttttctcggtttctaagaatttcagagccattatttttgaggcggctgcacacggccgtggagaacacgataataaaaacggtgctcgttctgtgagaaaatttcccctggcatgcaaggcatccagccacattcaccctcattattcactgcggacgtgggaaagtttttctgtaaaaggtaacagagtaaatattttaggttccccggaccacagtgtgtctggagaagttagaaaactcggctgttttagcacaaaagtcactgcaaacaatagatagataagtgaacgtgtttgtgtgctaataaaactttattgacaaaaacaagtcaggggccgggtgtgggccactgtcttaatttgcggattttaaatgatgcaagtgggttaaacacagtgattagtgtccttgcatcttccagagggcatttgggggctctaaatcttgtcctacactcattttggggtcacccagatgggctcaaataggacgtacggccccccgtttgccaacatcgtcattatcccgtgatgaggaggccttagaacgaataagcaaatttggcgtaaaccgagaatttgtcctcagcatctttcttaacacaactcgcccaggagggttctgtctcttgacgggagcgaaatgcgatatgaaacttatttgctgcctgtttttaaaaattcaatcaacttccctagaaagcaaaaaggaaaagaaagaaaactctgcacggattggctgtcttgactcgcagaaaccttcctgccctcatgacctcatttgacctccatcccctccttaaagacccgtctccaaatcccggcacgtgccaaggtcctgtggtcaggactcccatatgtgaattttagggggtcacggttcagtctgcaacacacacacgcacacacatgcgatctgcacggcccatcggacaaaagttccaactcgaggccgtgggctccctgggtcttgactctgcccgtcctgagtgtgtggacacacaaggacctattgtgagttctctggtttgaggttggtgtattctgatgggttgattgattaattgattgattaattgattgactggctgatgaatttggtcagtcccaggaaggccccactggaacaggtggtgcccatgtgaaaagagctaaattttgtcaacattcccaaagagcgtgcattgtgactctcaagagacgtcacaaccaattcctttcttttcttttcttttttttttttgctgaggaagattgtctcgctgagctaacatcgtacccatcgtcctctcttttatgtgggatggtgtcacagcgcagcctgatgggaggtgtgcgggtccacacccgggatgcgaacccagcaaccccaggcctctacaagggagcgcacaaactgaaccccttggccacgggtcaaaggaccagagacaggcgggccacccacctctcgaggggtccgcgctcatgcggcccgggggaggggctgctgcgccggggaccaaaggggggaggaggaggaggggctgggggaggaggggtgcgtggggtgaaggagcagggccggggggcacgtgtgcacgtcacacacgtctgtacggggtcagcgtttgcagagagagcgcggcatgcctgtggcgcctaatgtgtgcagagcgtctcccctgatacgcgcgtgcagacctgcgtgacacaggtgtgcgtgtgcgtgtttgcagggacggcagcaccgacgtgcgtcacgcgtactgacgggctgtcgtctgcgcacgcctgtcgcgcgcatgcgctcacgcttgtcaatcacgtcgcttgacggcggggtcacgggcggagaaacgcgtcgttaggcggtcccgtcgttgtgcgaacggcacggagggactcatgcaaacccagacggtgcagcccggggcccggggctccgtggggccgaggttacgggaccggggtcatccgtgcggccggtcacggggtgaaacgctatcatagggtcataggtcatattctatataataaagtacataacagacagcgttgtaggattgtaggtggctccattatcatatgcgcccgtatacaaccatgtccattgtgcgtttatagagcggtgcacacgttacacacacgtataacggttatgcgtgtgtgtagagaaggactttcacatgtatgtcgtatgtacacagaacacacatacgtgtgtctgtaggacgatgtgacacatacatgtgtgtgcgtgtgtttatatatatgttggccctacaaggaaatttcgtgcacatgttatatacagacacgtgcatagttatgtacgtatttgatcgtagataggatataagttgacagacacacggctatggtgtgcatacacctttctgcatgcatttacataaatttgcatgcacttaggtgtttagatgtgtagacagagtgtgaggtgtttgttgtatatacatattatacgtgcatcatacacgggggtcggagagacgagagactcacatattattcacacacacatggatttatgtatttcacgtatttatatgctcatatatgggatataaatttagagacacgtattcatatatagggtataaatttacagacacacagacttatatgctcacatatgggatataaatttacagacacacgtatttatatgctcatatatagggtataaatttgcagacacacgtctatagtgtgcacacatttctgcatgcatttacataaatttgcatgcacttaggtgtttagatgtgtagacagagtgtgatgtgtttgttgtacatacatattatacttgcatcatacacgggggtcggagagacgagagactcacatattattcacacacacatggatttatgtatttcacatattcatatgctcatatataggatataaatttagagacacgtatttatatgctcatatatggaatataaattgacagacacacgtctatggtgtgcacacctttctacatgcatttacataaatttgcatgcacttaggtgtttagatgtgtagacagagtgtgaggtgtttgttgtacatacatattatacgtgcatcatacacgggggtcggagagacgagagacagacatgttatacacacacatggatttatgtatttcacgtatttatatgctcatatatgggatataaattagagacacgtattcatatatagggtataaatttacagacacacagacttatatgctcatatatgggatataaatttagagacatatttatatgctcatatatgggatataaattgacagacacatgtatttatatgctcatatatgggatataaatttagagacacgtattcatatatagggtataaatttacagacacacagacttatatgctcacatatgggatataaattgacagacacacgtatttatatgctcatatatagggtataaatttgcagacacacgtctatagtgtgcacacatttctgcatgcatttacataaatttgcatgcacttaggtgtttagatgtgtagacagagtgtgatgtgtttgctgtatatattattacacgtgcatcatccacgggggtcgtagagagcagacagacacagcggagggatggcggggggtcgaggcagacgccccccacgcagcagccctgccccgggcagcaggatggtctcaccctgtctgttctcgtctgcagatctgacccccggcccggcgccctttgcaaacagccctgggtgggctccggtctccagaagcggacgtcgggtgctgaccggaggaccacagggcctcgcggggacaagacggccgcccgagggtggagacccggttctggcgggagacgggaggggtcagaggggcagggaactcgctccgggctccacggggcccgaggattccccgaggccagggctgggggccgtgctcagaatcagccggaggtcagggcaaaggttctgataaggtctgcacaggggtcgaaggtgggggaccggggaggggtcagctgtccggggtcaggcgagaggccaggagcggaggccccctggcggctcttggctcccgggccctggggtcagtcgggtaggactcagcgtggcgggcggtggggcgagtgtggaccagggggtcccgggttcccattccagccgccaacaattttcttccttctcggagacactgagtcccgggctccgaatgagaagcgagttgctgggagacggggcggcttggaccccgttccccgtcggcctggtggggagagaagccttaagttcctcaaggcggggacgccagcctggccccaaggacgacggacggggcgggggggggacgctgcagtgggaccccctgagttgccccggatcctgactcagtctttcaccaccaaaaatcccatgcacgcgctcgaatgagcccatgagcgccccaaggacgccagccaagggttcctcgattgactttatgaccgtcacagtgaagtgtgactatgaaatcgccgcttctcaaacgcactgggggtcgggctaaaatgcagattgcaacgcctaggtctgggggcgcccccaccccgagcgtctgcatcgcttggagggggggcccacggtcatggtggtcacctgggccagtgtggacggagcagggtccagggtcatggtgctcacctgggccagtgtggacggagcaggtccagggtcatggagttcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggacggagcagggtccagggtcatggtgctcacctgggccagtgtggacggagcaggtccagggtcatggagttcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggacggagcagggtccagggtcatggtgctcacctgggccagtgtggacggagcaggtccagggtcatggagttcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggacggagcagggtccagggtcatggtgctcccctgggccagtgtggacggagcaggtccagggtcatggagttcacctgggccagtgtggacggagcaggtccagggtcatggtgctcccctgggccagtgtggacggagcaggtccagggtcatggagttcacctgggccagtgtggacggagcaggtccagggtcatggagttcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggacggagcaggtccagggtcatggagttcacctgggccagtgtggacggagcaggtccagggtcatgactctcacctgggccagtgtggacggagcaggtccagggtcatggtgctcccctgggccagtgtggacggagcaggtccagggtcatggagttcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggacggagcagggtccagggtcatggtgctcccctgggccagtgtggacggagcaggtccagggtcatggagttcacctgggccagtgtggacggagcaggtccagggtcatggtgctcccctgggccagtgtggacggagcaggtccagggtcatggagttcacctgggccagtgtggacggagcaggtccagggtcatggagttcacctgggccagtgtggacggagcaggtccagggtcatggagttcacctgggccagtgtggaccgggcaggtccagggtcatggtgctcccctgggccagtgtggacggggcaggtccagggtcatgactctcacctgggccagtgtggacggagcaggtccagggtcatggagttcacctgggccagtgtggacggagcaggtccagggtcatggagttcacctgggccagtgtggacggagcaggtccagggtcatgactctcacctgggccagtgtggacggagcaggtccagggtcatggtgctcccctgggccagtgtggacggagcaggtccagggtcatggagttcacctgggccagtgtggacggagcaggtccagggtcatggagttcacctgggccagtgtggacggagcaggtccagggtcatgactctcacctgggccagtgtggacggagcaggtccagggtcatggtgctcccctgggccagtgtggacggagcaggaccggtggtagtcgccaggctgggccacgctgctgctggcacaggtccttccagtccagtctacacacagggctggacccgggtgagctgaccccggactcgcggacacgcccaggagggcacggcgttcaccggggccccgaccgtgagtgctccccacacgacccagagaaaccgcctcggatcacacatacgaacccccgtaatattaaccgcgtttctgcaattaaccgctggcaccggctaattgcagggcctgaaattagcaggctgtcaaaataacaatagtccgtttggcctcccaggacctaaattacttgtttctgcccacaaactacccgcatggattacacccattaacttttttttttctctttttccctaatgaaaagtctaagaaacgagggtgaagaaaaaaaaaaaacaaccctgcaggccttaggcctggcttgaaattaagtggattctcttcattatgagcgtttccccctaattgacgacggtaattggtcatcagcattagcacggatttaaacctctccccgccgtggcttgttgcgtagacgccgcggtcctgcgggctcgggcgggctggcggcggggggcggaaacggtgggcgtccccgagtccggccgtggggccctggcaggggtcggggttcaggcacggggtgcgtttgagggccccgggttttagggtcggggggacgcgccgtccggaagtgtagacaggaaacgggtcggctccgtcgggtcagaggtcactccgccgaggaaggcctgtccatcacggagggtccagcgggcaggaggccgattccaaggtgaggatgcgctgaggattttcccagaggcccccgcgctccgggcagccgggcgtttgggacgctggccgtctcctggggtgcagcccagccatgatggcgggacccggggtccctcactgaccctgtcccgcgggcccagaggacgtgggggcgagtccaggcccccgggacgcagtgcaatcacggggggcggctggaagaggcggaccggcgtgcaccgcgcgcgcgcggctccacccggcgtcaggggccgagcgcaagtgattgacagacgcgcaggtgattgacaggcacgcgggacccgagcccagctggaaagggagaccgctgtgcatctcgggccgactctctccatctctgtgcgtgtctctcagtgtctctgcatgtctctcgatagagatatagacacagttgtccacatagatgggatataggagtggatatagttacagacagagatggagatagagatggatatggacatagacatagatatggacagacgtatagatacagatatagacagagggtcacagatatatatacatataaatatagatataggtatagatatagatatgatacggctgtagatataaatatggcattaatatagattaatagattcgatgatatatcgatatagatatatagatgtcgatatatagatatggatacagagtaatggattagctaatacatagatatggacatatatagatccagattaatagattagctggtacatcaatatggatatagatgtagatacagattaatagattacctggtccatcgatatggatatagatgtagatacagattaatagattacctggtccatcgatatggatatatagatatagatatggatatagatacagataccgatcaatagattagctggtccatcgatatggatatataggtatagatacggatatagatagagataccgatcaatagattacctggcccatcgatatggatatatagatatagatacggatatagatatagataccaatcaatagattagctggtccatcgatatggatatataggtatagatatggatatagatagagataccgatcaatagattagctggcccatcgatatggatatataggtatagatatggatatagatagagataccgatcaatagattagctggcccatcgatatggatatataggtatagatatggatatagatacagataccgatcaatagattagctggcccatcgatatggatatatagatatagatatggatatagatacagataccgatcaatagattagctggtccatcgatatggatatatagatatagatacggatatagatggagatacagatcaatagattagctggtccatcgacaggcacctatggacccggatgagacgcgcttgtagacacgggcctcccgcgtggaccagacgagggacccccacgaagccgtaaggaaaacgcagacgaccccacagcccagggacgcgcccgcccggaaggaggacctgggacggaccacctgctcctggagatggagacactcgctgtgcgcggcgttcaaggcctcgggccggaaacctcggggagctgtggctgaaagggagggagtcccagcacgaggggctgtcttttcgctgtttgtctccctcgatggggacgccgaccaccaggccgtccctcgggaggagcctggactcggcttcgggcctcgggtcggtccctcgctgtgcatgccgctctccccgtgcacgtccctgagcccaaatatcctcttttgataagcacgcccgccagtcatgtcgcaggagggcccccctcattccaaggcgacctcgtcttcactagcgacacctgcaatgaccccgtttccaaaacggaacctgttctgaggtcctgggggtcaggaggtcatggctcgagcttaaaggacacacagctcggagcatcgcacacccccggccgggagccaaggatggagacactgtttggaccagggggtcctgggatggggagccggcgtctccaggcctctgtgcccaattcagaaaacgggtgctgggacccccctccatattaagagtcccagggtgcttcctggcctgggatgctgtcttgcaaccgtgccctccccggaaggttccagaaagcgtgcctttttgttcagcccacgaggctacaacctcccatccttgcttacgggcgggacccgggttgcaacacgatttcgtctgaccggacatttgcacggcccagccgcctgcaggaacgatgcgaatgaagggccccctccgggttcgctgtgctgaagcccagagacgtcgtcacccgcccagagagatgcaaaccgcagcgggtcccaggcgggtcctaggcatctgcattcgcgctgcggttgggccgcctggatgcacgttgggcctggaggaacctgcacgacgtgaggcgggagcccgcttccggcattcccacagagaactcctattcgaacgtctggtgtcctttttcagaccgaggcctggagtgacgggcccagagccccggaaggcaggaccctgtgggggctccatttaggaagcaaagattcccccccttttccttttgtgaggagttcgccccactctgggtgcacacggaggacacgcttatttagatatttccagtgggttgcgttcaccgggccctggacggaagcctgcaaaggtggggggtcccagagaccaatggggggggctgccctcctccaagacgggggggggggtgatgctcataaaggacgaccccggggcgtgttgacctgcttccgggggcgcagggcgagacggacgcacgagcgtgtgcacgcacctgtgtgcctccgtgtgcacgcggtgtgcacgcgcgtgcgcgctcgtttcccctccattgcggcccagcgaggtggggcgggtggcaggtcggctccgaaaattgcaacgaggaggcgtttgcaaacaccatctgccaaacggcgacgcggggcgtggggcggtgggggggggggggtggtttcttgtcaaccaaaggcccgcgccggttgcaaacgaaacgagttcgtcggttggctggtggtgttccaaatgaaaaggagattaagccacctacgcggaggcggaggaggcggcggcggtggcggcggctccgatttcttctgcagaggcgggagcccggtgcgcgcgcacccccgccccccgcgcatgcgcactcgcacgaggccgccacccgccccgcctcccgccggcctcattatctgtgccgccgcctgactcaccgagcgcagcataatcaaagcctgcgggtacggattaattatccttttgaatagggatgaaattttaaaaagctctcctgcaggcgcccgtcctccgcagatgaaacaaaagacacgcacagcttgcgcgcggggcctcacatgtgtttttacatctgttcgggatatttcaatttgaggctcccccccccccccaactccccacacccctcacggagtccgggattaaagaccaggagtcggggcgggggtggggggtgtggtggagacggagcagggacaggacacgccggcccgcggtcacgagcgggtcccaacccggttcgcgcgcggagctggacttgggggtcgggggggtagggaaggaggtggctcccgccccccatcccgagatgcacgaggtcggagcgggaagcgattgcgtgccacctgtagggtcctggggccaccgggagcccacctgtgacctccagactgtggggttcgctcctcagcacgcggccctcgcgggaccccccacccccccaatagcgtcagaggatgagtttccaacatttgcacacgctttggggtctaatttgaattaaaactgagctctgggtgggggcagaatgagaagggtcccatgtgtgagacgttttggggtgaccagcaaggggtctttgcaatgcgaggaggtcgaaggtccgccgtgaagacagaacttgtttttcctgcttgcgttaaactgggatgcttgcaaatgccaatgtgcatgctttgttttttttttttttttttttgctgaggaagattggccctgagcgaacatctgttgccaatctttctctctctttttttttctcttcttctcccccaagtcccacagggcatagttgtatgttctagttgtaggtcctggttgtgctgtgtgggacgctgcctcagcgtggcttgaggaacagggctaacttcacgcccgggatcagaactccaggccgccaaagaggactttgtgaatgggaccttgtttcaaagcggggtctttgcaggtgtgatgaatccaaggatggagaggagggcttcctggaggaggcggccctgaatcaaggatggagaggagggcttcctagaggaggcggccctgaatccaaggatggagaggagggcttcctggaggaggcggccctgaatccaaggatggagaggagggcttcctggaggaggcggccctgaatccaaggatggagaggagggcttcctggaggaggcggccctgaatcaaggatggagaggagggcttcctggaggaggcggccctgaatccaaggatggagaggagggcttcctggaggaggcggccctgaatccaaggatggagaggagggcttcctggaggaggcggccctgaatcaaggatggaggcagagacgggagggaggcggccaccagcccagggaccctggagccccggacgccggaagaggcaggagggccctgaaggcctggggagtccgttttctgaacccccgtcagtgtacagtctaccagggggaccccaggaccgacctcgaccgggaggaccaggtggatgcaacctcccagggtgaccccacggctgacccccaccaagtggaccccgcaaacccacctcctcgggtcaccctacagctgaccccaccccccgcttgtcactggttgcaatgccttttggctaagggagctcgttgaagggaccccctcgacttggggtcttaacctgggtccacagtttccccagaggcatcctgggtatcttgcagccatggggggacttttatgggtccttctaaggggagatccatcgccttcataggattcgaaacctcaggaaggttgagatcctctgctgtcggaggtcaaaggaccccaacgatggagaacggggggtccctttgctcctcaacccgtagctgaccccgtgggacagacgtgtggccatatgactgcctcgatggccctttttccgaaacgaccctaataaaatattcttgcaaaactcgcggagggggaggcggggggtctggttcccagatgggggcggggacgagcccggcgggacgtgtgcaaaaaagatttgtctgaaaacggggccgggccgggccgtccgatgatgggaacagtcaccgtttctcctcttcaattggatattaggtcataaaaatccacatttctcctcctcaaactgtcttcttgaagcgtctcgacttttttttttttttccccctcttttctggatctcgcttttttttttttttttttttttttttttttgtcgtctccggcttcggaggaaagacagcatctggtctgatttttcaattttttctttttctttttctttttttttttttttttgcctaataacatttttcttctcgggtttcgtcggaggccttgataaaaggacgcctggtttatgagttggcttttatgacttcctttcgctgcggtcgctgcgtcggctgcgagatttttttttctttttttttttttggccttcagtccggcttctttctttcctccttgtttgcatgaggttgtttagaaaaaggggtttttctaagaggggcaaacgaggggtgttttgggttttttttttttttttttacctaaaatggatccacgggaagtgccctgtggatgcttttggtgtcaaatgaaggacgcgtggaccctacgacggggcgttgacagacccagaggacggagacggaggaaaattatgggttttgctcacagggagcagaaagaggagaaataggattaatcgacgggattggtgttggaggtgcaaagattttcatcctcatcctcatcgtcacgacatgagcgtccggccatcgacacgaacttggagcatcttctcgagttcctgtgccacttttcgcctcgaaaaaagaaaaaaaaaaaagctgagcaccccaagaccccgttccgagtgcctgtgctgcccctctgtctcgaccctacgaccccagacgctcggacccccgtcctcatccaaatttcggcccctggtcgtcattcggagccgccacctgggcctggggggggggtctcccgtctacaccgtgatggtgatttcaccgaccctgcagggtttcgcagcttccctgcttttgcacccaaaaccccagagccagagggagtttccagaaggttccacgctttcacctccttcccctcatccctcctccagccccacctccgtcctccaccacccgcccatcagcccatcatcctccgctgacgtcggcaggacgcaggccttattgtgtgcgtgcacacgcgctcacacgcgtgttcaaagccacatgctatgacccgccatggggagaggtccagacccgcgagagcggcaggtacagcgccaggtggcccccccccaccccgtcccctcctggaccccactcggctctcccgggggacggacgaggcccaatcagcagggtgtccaagaaggcccgcaagcaagcaagcgagggtcattctggggctgccggggcgccggatttgtggagtacggggatcttgaccccccccaagtccccacgactccgtggatgcagaggaggcctttccacccagacacaagacgccctggaaagaaaaaccctcatctctgatcgaggtcgtttttaggagtttcactcgagttcatgttccgggttggggggcgggcggtgagggttcaatttccttttgtcttatgggttcggatcactcggagtggaaacgcttccggaggtcgtgcccccgaggaaacagaggaggtgaccggtggggccgtggaacggacgccgggtgtgcagctccaatgccaagggcgtgttcagggctgtgactgtgggttggtctacacggcccaccacgctgtggcccattgtgttaaattgggttggaagcagacagagagaagatggcatcaccttggggtcctccaggagggctgcctggtggaggcggtgggcctgcatctgagatgagggggggacgtgggcccaggtcctgtccctggtcctccaggagggctgcctggtggaggtggaggtggtgggcctgcatctgagatgaggaggggacgtgggcccagatcctgtttttaggatcaataatttgtgcccagtgctgtgcaatccagacaccactctgagccttcctgtttatatgactttgatttaaaaaatccttgatcccgtcccctttcctataatatttaaatatttatccctcccgcctgctcattttgttggacaaactgaacgagatccaacgaaaataagtgaattgcctgctcatccttgattttcatttatcgtaatttatacaagtccacgcctttggtcccccggaagctcacacaggcaggaacaccaccggtcgcgagcctggaaaacccacagcattacgcattaaagccgtgttttacctgcaagcccttggcatctgggattccctttgaaggttcagagggacgattatccgcgtgtcctccgtgcgggatcgccctccgagaccccgggccatgaagcgggatgtggggatcctcagctccgaggatgaaaccggattccaggaggcggcggccgggccgtccctttgatgtctcgccttttgtttgcagttggaaaagctctggaagggacgaggcggggcccacgtgggtcttgccccagccatcggccgcccggtcataaaaccccggctgaggggtgcggaggaggtcgaggtcccaggaccagggtggaggcccctcccgaaatgggggacaaagacgcccgggcgtgcgtgtcttttggcccagctccgaaaaacccaattccggccccggagagccagacgtgagggagccggatgtccaggtgggaatcaggcacggcttgactcagctgcagcatttgcacgagccgccgttcccctccctggttccccggctcccacacagtagggcgacgcctggggccttttcctctgcttcctgcacatcacgtccccccgtccacacccccccacccaaagtgggaaggtcggtccaaacggcgggcacaaaccgacgccccagctccaagcccgtcgggcacagagagcccggaaacttctccctccttcggccccttttggttctattcagccgtcaactgattagacgtggcccacccacactggggtagggggacatccctctgctttactccatcctgccgattcagatacttgtctgaccgagcccctgggcacccggcggcccaggtggggtgacgcacaccgcgacccccccccccgcaccccgtccccaccatctctgctctcaactgggtccttcccaccagcacagaaacaagctgggattttccccggggagcccagctccttggggtcgccctcccgacccaccgcctccctgagtctctgttcctccctccagcaaagagggggtcccctttgcgtggccccgtcccgccagccacggatccctgttcctgtcctgtggggtccctggtctccccgaattctgctccctttctgttctcctccctcctgtctgaccacagctgctcaggcttccggaatattctttcccaggcctccagccacatgccaatcactccttctccttatttttattttattttttttttgaggaagattgccatgagctaacatctgctgccaacgctattctttttttttttttttttttgctgaggaagactggccctgagcgcaaatccgtgcccatcttcctctactttatatgtgggatgcctaccacagcatggtgtgccaagtggtgccatatccacacccgggatccgacctggcgaacccctgccccccccccagcaagctgcaccaccaggccggcccctcctccttatttaacacggaaacggctccagcgcccccaaacccgcttccttcatttctaacacaccccacacgtggcttatttatggggacagggtctctgttccgttcccgccaaaccgccccacacctgaccgggacacggcgacacccgtttgtcgaatgactaaacaaggccggccggagtttggatggggggcgggggagggtggcgacccgcgtctctctcgtgaaccagcctggccccataaacatcccggccccaacccgctttgttgcttgcgaggcatctggtagccggaacggtccccgtctccttccgcgggttcaatggcgccgccctaacgggacgcacgcagagcgttgcgggcacggcggggcctgcgggttccgggctgacgaggtgctaacgggaggccgcgggggcggaaggacccgccgcgtttctgagtcccgtttggggcctgtagggccggagcctttggaggtttgcacccgattccgggacgcggtgcgggtggaggtggcccaggccgccgtttgacgttttcctcgtcttcttgttctccgtttttttttttttttccctctgctttcccccaggtctgggttcgaagagaagccgcaggggccggcctggtggtgcagcggttaagtgcacacttccgcttctgcgacccgggattcgcgggttcggatcccgggtgcggacatggcaccgcttggcacgtcatgctgtggtaggtgtcccacatatgaagtaggggaagatgagcacggatgttagctcaggactaatcttcctcagcaaaaaaaaaaaaaaaaaaagaggattggcagcagatgttagctcaaggctaatcttcctcaggaaaaaaaaaaaagaagagaagaagaagctgcagaagctttctgggaagggtagtgtcacttctgtgcacacggaggccgacatgcctccaggggaagccgtgctctgcaggatgggggccccctacctgctgaattacccggaaaaccgggcaaaacggcagtgttttagacatctggatactggacaccatcttttttcgtggcgaagacccgcgtccccgtgaattcgtgagacgagtcctcaaaatgacccgtgtggaggacggccttgatcgccgaggcctgtcagtccctctgtgcatgaaatatgacgacattcgacggcgaaacggggtctgaggaccaaaccccctcctgtgacgggtacattctggtatgttttttaaataaactcaattttttcgatggcagtacttttcgtcaaaatcgtggtaaaagacacaataatatgaactcgaccgtctcgaccatttcaagtgtgcaagggtcctggggcggccccagtgaacaaccccaaacctggggctgaaaccccagggttccgtcctcccccatcctggagcccagagtctgaggtcaagggtcacagggccgccctccctccttccaggggccaccctgccgccttccccgcgccccgtgaggccgacacccgggtcctcctcccgccttctgactccaaattcgggcttttcgcaggaaaaaagcaccacagggcgtcggcctgcccaccacggcggcaccgggtctgcctcagtttccccatccgcatctgggaaaacggtccccacgcccagggcgccctcccggcttcacggatgacccagatccccccccccccaccgcgtccactcgcgtccaaatccagtcccaccggggcctcgtgagaaaaaacttgcatttcacgaatagcctgcaaactcactttttttttttaacgttaaaaaaaagaaaaaaaaaaaagctaagcgcgcatttattttcttccccccaaacaataaactcttggtgcctgggtttctcccctcagcgttcgggtcgttaattatgaggccgggccgtgtgcaaaaggccgggcctggcgggtcgggctgcaggcgttgggggtgggggatggggggctgcaacagtgggggcttgtccggaggcggctggagggaggatgggcggcgggaggggccccgaaaagggccactgtggcctcgagaaggaggcggggcgggtgccagtgccgggcctgcaagacatttaaaataattttaaaaaattaaaaattttttaaaattattttatggtcaacagtttcaattggggaaaatgaacacgatccggagacggatcggggtgaatgtgcttcacgccccggaaccacgcacttaaaagcgatcatgaagttcagcccagtgccacgctctggtcagagccagtcttcctcagcaaaaaaaaaaaaaaaaaaaaaaaaaaagaggaggattggcagcagatgttagctcagggctaatcttcctccacaaaaaaaaaaagaaaaaaaaaaccgaccaagatggtaaattttatgcgctatgtgttcccggcaataataaaaagaatgttgtgcgcagaaattcatcacattccttccttcgcggttgaatctcctcgtccccgtctctcgccgtaaacggagccgccccggaataagcgctgccttcgggatgtaataaaatcttacttaaggataatagaaaccatcctatttcccgtgagaatgtagcgttttcgggacttagggccggaggcctccggttaatcgcggtttcgagggaaaaatcttggcgggtctttgcgaatttcactggttctgtttcgagttttcccaaagccccgggatctccagaaaaaaagggtcccggcctcggggtcaggtggcgcccgcccctgggactcggagatttttgtgaaaaaaaaaaaaaaatgcccagaaaaaaaaaaaaagcaactttcagaaaccaacgggctcggggctggaggagaaacggtgggcgttgcggaaaaaacgccaacgcgtcgtttgtaccaaaccctccaccacgaagggcctggaacccactgggagaaaacgggccccattttcagtgggaatcgttggggggggggggccttaggaaattatataatcataaatctgagcgatggagtgggggcccttaatgagtttcagctggatttggctgaattctggcatttctgaatttcagaaccggggccataaaatgtgcaactcccccctcggttattcgggctcaacaacccttaattgtgccattcgggttttttttttttttttccaaacgaaaacaacaagggggtcttgaaggatggaggcagaaggaaaaggacacacttcgttttacgcgaattgggggaattattttttttttttacgaggggccacgggcacggggcacggcagggtgggccgggctgcactcgggtacgggccgccctctggggtcccgggtgtcccccggggccgttagcggctgcaaaagtcagtctattatcacgaagagagacgggaatgcgtttggggtgaattaaggatgctgggccccccccaccccggtcgtcgtcgggtttgggggtccgaggcctgcggaacaaacggggcactcggctggactcacctttttcttcctttctgtccccgtttccaggagccgcggggacctgctgccacccagtggcggcccagtgtgcgggctgagcggaaactcggatctcaagccggtttgtggagggagaaagtgaaagcgtgtcgaaaaggctccatccagaccgggtgcccgacaaacaaacacaaagcaagtcctggggttccctccccgtcttcgcctccggggaaaggttgttgactgactgactgagcgtattttgtagaattttaacgcggagctttctgggtgggaggtaaagaggggaggactcgggcctttctgtgggtcctcgtcaaggtcattgccgtcccagatccggccagtaacttgggacaaattgcagccaatccagtggcacagtctgcaacatggtgaacggtgcatggtaaactgggatgcatttggctggtgcgggatccgagggctggtacgatgcgccgagtgggaaaaattgagacccaggtgccggggaaatcaaagcgacggaggacgctatctccgtgttgaaactcggattgccaggaagcgtgtggcgttggactcagagctgcattggacgcgactcgtttttcaagcgtcactgagacatcggtccgggttttctcgtcttttcgggggagcgttttgcgaggtgccttgtgtttgttctgcaaccagacacgagggggatttagggccggacgtggggcgcccccgaacccccgccccgcagacaccgtgcttcttcggggtccgcgttgcaacgcaggcctcgatcctccgagcccggggggtgcagagtccaaacgcacggaatgtgtttgctgtttaaaggaatcgagtctcgagaaacaccgttaagcgtgcaggttgcgagaccgttaagcggtggttgggttttgcacacgctccttccaggaaaggctgtttggctttaaaaagcgagaaccgtattttatccgtcagggggacgttcgcaggttgtatttcttccttctcgggctgtgaaaacggtgggcgttttccttccctcctttcttcagacgcggactccgggcgtctggttaggctccgggagctgcacgttgctgggaggccggtgagagttgagtgacagctgtgtagacggacgggccgccggagcccccccacccactccggctcggaaggccgtttacagcgttaccgacggggccgtggtgaatgggacttgcaacgctggccgttttccacgggcagaaaaaacgttggccgtttttataagaaagtcttgtgttaaatagagaaaaggggaggtcggactcacacctggagacgggagtggaggaaaaaaaaaaaagaaaatcagagtgtgtctgtgcccggacgggccgtggtgtttgtgaatcggtttattttggttttgcacagagcagagcagccgaggcagtgaaaatattggtagcgtggactctgccgttagaagatcatttttttccccctatttttgggcacccgttttccaggccgtggggctgctgcaggagaggcaaacgcgtttcttggaaatgcaggacttcggacggatcaaacggagcgttttcatgaactcgggaaccgggtgtagacgggatgcagggagaaagtggacccgctcccccgaccgagtccggacggacagagcagaggggacagacagaactgctttccgggctgtgtggtccgagctcagccgtcaaaacggagcgtccagcgttcctccgtccgttaattctgcgtccaggacgccgactttcaggggccgcgctgtccttgcagaaacggcctaatcctgactttgccagcgacgtttccgggtagacgttttttttagaacgatcgacgccattccctgtgtaactgcacaaatggacagtcaggaaaatgcagcggagcccttgcagggaggtggaaacggagcgcgttaaaatgtctctaactttgcggtggagacaaaggagaggatacaatgtatccggtcttacgtactcgagtggaagcgactggtaggatacaacgtgtccaaccccagcagttagatacaaataaatgggacaattagatgtatctaaccctaggcacaaatgaagagtgggatacaaagtatctaattttacgatagaaatgaccggaaggatacaatgtatccaatgtgacacactcaggtagaaaggactagtaggatacaatgtatctaatttaatgcaattggatagaaataaatggtagaattaaatatatctaaccttatgcacttagtaccaatgaaaagtgggttaaaaagtatctaatttcatgatagaaatgaatgaaaagatacaatgtatccaatgtgacacactcaggtagaaaggactagaaggatacaatgtatctaatttaatgcaattggataaaaataaatggtagaattaaatatatttaacgctacgcgcttagatacaaatgaagcgtgggataaaaagtatctaattttatgatagaaatgactagaaggatacaatgtatccaatgtcacacactcaggtagaaacgactagtaggatacaatgtatctaatttaatgcaattggatagaaataaatggtagaattaaatatatttaacgctacacacttagatacaaatgaagcgtgggataaaaagtatctaattttgtggtagaaacaatgggaggatacaatgtatccaatgtgacacactcgagtagaaaggactaggaggatacaatgtatctaattctgcacagttacctagaaagaaatggtacaattaaatatatttaactatatgcacttcgggtgcaatgaacagcagaacaaaatctacgtaatcttacgcatttgggtagaaatagagtaaaatgcaaaatatcgcgcccgacgcacttaggtggaaatacacagtcgaacgacgaggcctaatcttttttatacacgtttttgcctaaataactgccggtgggagagggccagctcagacctcccctttctcggatgagggaatcttttctagaaataaattgtaaaccactagacaggccaaggctttacgtcaactctgacacacggaggccgggttcaaactctactctcttttttcttctccccatgccccggatggggagagaggatggccctcggatggggggcagcctgtgggcaacggggtgagcctgtcccgttttttgggggacacgtcgcttcccggggagggtgggtgtgtggacgagggtgagaatgtcccagagcctctttccagggccctggtttgcaggtgaattgattgacaaaaatgcactattaccatattgacactgaagggatccagaagcagccgctgtggcctaaaaaatattgggagccgaaggcacttaggttcctgaaattcctgatctcccccaaagaactcgatgtcataaacacggtccctcgtagcatctctgatctctgctcggagagggggcctcagcacgacacccagaaagaatttgttgcacaaacgtatctccttatatggtaaataagcccaaaattccatctgcctcctggagtcacagttctctgtaaactcccatgcggacgtgcgtaattaaacctgttttattctcttgtgaagagtttgtcagtttaatttgcacaccccgagaacagaacttgacagtgtagaaaagtggttcctaggtaggaatggtattgataacagtatgaataactgtgaatagagggaaaggcgtcccccaccctatgttgatctttgttcttgtttttccctctttcttcctcaaattttggcctccccagatgcagacgaaagccaagatttgagctttcttggagtcaccctccttgtgcccccgagatgggagccacgagactgggccccctggcgtgtagttagcaaaggcccacgggatgctgggggtgggcagcagtgcaggaggggactcccgggctgagaatccacgtggccctgacctctgacccgggatgaccccagagccttcgatcttgacgccaaacttgtcagatgacgttggtgaattggtccgggccgaggagagctgtgtccgtaaacccacggatccccctgagggagtctaactcaagcctgtgtgagttgggctcacgtgagttgggccttaagggataggtgggaattctgggaaactggacgtctgtaaggtcggagggagccgttccatggaaggaggccaacccgggggcagcgaagtgtggccggggggccgagggtgggatctgtggcatctgagggggaggtgagtcccgaatcccacatcagacaaagccgttggcggttcaggataattctaaataaaccctgatatgagacacacacacgggcaacagatgttagctcacggccaatcttcctcaccaaaaaaaaaaaaaaggaaatgggaaaaaaatacggtctatcagacagtcgatgcccgactggtcagtagggacattatatggcaggagtgggccgctggagacgcacggggtctcccagccctggaatgaaggccgcgtcctcactccctgccgcacacggaaggatccccgggcaggtgacaaacctcagtgtagacggtaaatctggagaaaagggagattttcgtatacaaggaggaaaaagtaccaaaaacggggaaaaccaggacagatggagtcccgcccggtgggaccttattgggatcccgtgtcccctccaggccccccagtggccctcactcaatgcaggaagctggcccccacctcgtgcctcgtcagggccaacagttagtcactcagtgaaccctgcttcctgcagaggagaaaacgggggtccacagaaaggttggtttctttcttttttctttttcttttttaaagaaaccccaagcgtgtcaggccggccccacaaagaacagagacggtccaacacgccttttgcctgctttctctgcctgcccgccgtgaggacccgctcgaaaccccgaagatgattctgaggtgtagacgtttgctgtgcagcagaggctggaaacagggcttctctgagcttcgctcatcggacccaaagcaggagcttgtgggaaaccaggccccataaatccgtcttcggggtggacccgctcccagggctggaaaacccaaaaaacctcccccggggcctttctccaggggccgtttatggccccgaaggagttggaaagaccactcatctctgtatagacagaaatcagcgccgcctttcttatctcttgtttgttctcgaaaaacccgcttatctctccaaaagatcgcagcttttcctgtaagcgtcctcgcccagaggagacgtaggagaagccccaaattctaaccgcccgtcagtgactcacgaggggaccagggccgactcgagtctgcgtagcaaaccctattaaacagcctgattcgccataattcccaggtcaccttcccatcacttgcggccccggcccagaagccctaaatatcttttctattaaattcctgggggttttttcctttttaatctgcctttggacaattttattcacgggcccccacccagagaaccaaaggtgagcagaggaaactggtttttctctctacactcgtcactgaatggttttgcatgtatgcgcgttgcatgcataaaccaactctttcttttttctcttgttaattggtcttttgtcgatttaattgacaggcctcacgaacagaacttaaaagggtagaggaaatttttttttgtcttcgaccatgcagacctcagtctagaactatcatgacctacggatttctcttaagagccacttggaggcggagaatgtggcagccgtccagtcctcaatgaggccagattctggggcaatgtcccaaatacggtggccgtcatgcccgagctgagttctgcgtatggacgtggaggctgtttctgcaccagccccgaagtgaggccagcttgacgtccccgtgagctgtggctgctcctcctccagcctctcccccgggacccccggctgcccttgaaagccggggtcccacatcagagaagcacgctgggtgggggccccggggcgggcggttgttttcctgcggctgcgagaggacagcgattacggggctccgaagagatcgtcgctgttgagaacatcctgcgagattttccagcgctgccccttgtctcggtttcctggggcggccgaaacgaaggaccccaaaggggcctaaaccccagaaattcatgctctcaacgtcctggagcccagaagtctggggtgaagggttgcagggtggcagagtgagcgggacatgtggggctggaatgcaggccttatcagggccttagggtccctggggggctggaacaaaatcctgcaaacttggtagtttgaaccccaggggtccaccctcccccgtcctggagcccagagtctgaggtcaagggtcgcagggctgcgctccctctggaggctccaggggagggtccctcctgcctcttccggcgtccggggctccagggtccctgggctggtggccgcctccctcccgtctctgcctccgtcctcacggggctgttcctctgcgtctgcgtctcctcttctgtctctgatgaggacgctgtcctcggatttagggccgcctcctccaggaagccctcctctccatccttgcatgcagggccgcctcctccaggaagccctcctgtccatccttgattcagggccgcctcctccaggaagccctcctctgcatccttcccttcatcacacctgcaaagaccacaattctaaataaggccccattctgaggtcctggggggacgtgaacattggggggaccctacaaatgcatcacaacccctaaaaaacccgtcaaacgctcgctgttcctccccgtcgtcctcatgacgcctcttccattcccatttccccaaagtcaagttaagcccagaaggtgattggctttccttgaatctccagctggaggagccccgggaggcctggttcctatcgaacaaatagaataatttaataaatacaatatttagcttaacaaatatataagttccattgaatgtatcaaaatagcaaaataaataacccaaaaccaccatgggagaggccttggcaagaattcgtcggtgcgtaatgaaaagttaatccttatctaatctatttaatacccacaaagagcaaaataagcctttaataaatagaaatagtggagtaaataagcaaaaggatttaataaacgtataatttattgaataaatggaaatagcaaaataaatcacccaaagcggttagcggagatgcaaggactgttccgtgcctaacgaagtggctggaatatgaaaaaagggggaaaaaaatgagaagcggagaataaatatttgaaaagtaaacctgcgcagcctggcccaataaagacaaaaaatgaatcctcatggaaatgccgtttttccctttttgggtcattttttcacagggaacgctcagcgcggggcacgagggtccacacgcggggctgggaggccaaagggaaacccagagcctttcgaggctgctttgcctttgggcctggagaaggggattcaagtacgtaatgtctacgcaggttgttggaggcggccgtctcaccccgttttctggtcgtttccgtggagcccccttgggcggccccgagctcagtcattgagacacacgacggggcgtctgtgaggtgggcgccccctctgccccgtcagagggccaggaggccctgcatccgcacggcatcctctggggtgcagagcgggtcatgggagacgggccagccaatcagagcacctggcctggcaggtcatgtgacctgggctggccaatcacagtgcccggacccagccgtggtccagggctggccccaagcagctcctctgggatgcagagtgggtcatgggagccaggccagccaatcacagagcgtggtctggcatgtcacatgatgtgggccagccaatcacagtgcccagcctggcaggtcatatgacctgggctggccaatcacagggcccggacccagccgtggtccagggctggccccaagcagctcctctgggatgcagagtgggtcatgcgagccaggccagccaatcacagagcgtggcctggcatgtcacgtgatgtgggccagccaatcacagtgcccagcctggcaggtcatatgacctgggctggccaatcacagtgcctggcccggctgtggtccagagctggccccaagccactcctctgggatgtggaacgggtcatgtgacccgggccagccaatcgcagcacccagcctggcaggtcatgtgacctgggccagccaatcacagtgcccggcctggcaggtcatgtgacctgggccagccaatcacagtgcccggcctggcaggtcatgtgacctgggccggccaatcacagggcctggccctgtcgtggtccagcaggccctgcatccgcacagcatcctttgggatgcagagcaggtcataggacctgggccagccaatcacagcgcccagcctgacaggtcatgtgacctgggccagccaatcacagcacctggtctggcaggtcatgtgacctgggccagccaatcacagtgcctggcctggcaggtcatgtgacctgggctggccaatcagagcatccggcccagccatggtccagggctggccctgagcagctcctctgggatgcagagggggtcatgggacccaggccagccaatcacagcagtgggcctggaaggtcatgtgacccgggccagccaatcacagtgcccagcccagccgtggtccagggctggccccgagcagctcctctgggatgcagagtgggtcatgtgacccgggccggccaatcagagagcccggcccggccgtggtccagggctggcccctagcagctcctctgggcgtggacagcggggatcggggcagcaggtctgtccggggaaggggcagggcgggcggagggacctggagtgctggggaggacggggaggccaccctgagggggagaccagcgaggaggccagcacggtgagaagtgaggacggacgtgtggacagggtgggccagcggctgtgacgggagcccagatggatggatagatagatgactgatcgatcgattgataacataggcacacatcacacataatacacatagtaggacagacagatgttagatacacagatagatggatgacagatatgatagatggatggacagacggatggatagatggatggatagatagatgatgaatagatgatcgattatagatagatgatcgatgcatatggatatagatagaaatagagatagagacctgtaaattcacactagctctttcttcttgggaccatgaagcctgaccaacaccagcggttatcaaaattacatttatgaaggacagtttttaaaacacagagaaaggagttttccataatattaaaaagaaaaaaggcaacgtcgaaaatcctaggtgtcgtatcatcggcaccatgtgaaaataaccgtgaatttttgaaatacaggatcggttctgctgctttgtatttgtcacgacttccatgagcgtctgcagccctgagagaagggggcgtgggtgggggcagatcccgggagaagggggcggatcccgcgagaacggggcgccggtgggggcggatcccacggatggagacgcacgcggaggaaacggaatgaaacccagttcgcaaatacggggttgtagggttttccgcgttgagaacgtgcagaaattcctgggttcccattggctgcttctgatgttcgccacccgcgagggtcccctgcgcctggggaggcgggttggggaccagagacgagcaaagagatgggttgatccaccagcacgtggttgacgcgctgggtgaccgccaagggctcctgtggggtcttcacggcgggggcgcctggtgtgaacggacgggggtgcgacccctgagatgtgagcggagggggcggctttgatccgaccccgaggcttcagggtggacctgtcctcctgtccgcgaatacagaggcgggatcaagagggcggggtcagccgctggagggaccttcgtccctttgtggcttcgcgagtctgggggtcctcgccatctctccgtcctccagacgttccctcaacgcccggaggagctggacgcggcgatggtcccccggatgtcgccatacatcaaccggatagagacagttaattttaggggtccgctctgctggctcatggggtcccgggaaactcgggacaacgtcattccgcgtatttctgggagggctttttgggagtgagagtcacagcgaagtcggtagatttggaggcaaatgggatcgcacttcccaatgtgggtgggcctcgcccaatcagttgaaggcatgacaaaaacccaaagagcggtgagaaagaatccccgagcggtcgcttttttgggccacgtcgactctccccgggtctccagcctgctggtcggccccccaaatttggggcctgctggtctccatcatggcatcagttgatgcctgatcatacatctttttctcgctctccatatatatatatatacacaggcatcccatttgctggaggcctggaggctggacgtctctgttttgaaggggcctccccaaaataataaaggacccagggaggagcttaacagaagacgtgcaaatcgttggtggaagaaattgtacgtttttaccaaagggcagaaagaacatctgcacccgtggaaactgacaccctatttgcaggtggagaaggtcgtagattcattcaatgaatttctagtgaagtcgaaatggagtttcaccgggtcatagattcatttaatgaacttggggttgaaggcagaaagggtttcctgggccacaacttgcacgctgtccggggtcatcacattcctgatactttgttatgcagcttgatcgagctgatccagtccccaacatacagtttacaaacaaaagtatctacacagcatcaacacctacttaccctgtggaaattattataacttccgggggggaaatgagcacgaggtcgtgcatgaacccggttcaggttccacgtttcccgggatccagaaaactgtgcggccgacaagccagaaatgctaggacatgagcacagtcttcctgggaaacgctgaacgtttttgaccgtttttgcccccaaaagcgcatcaggggccgaggcgtgcaggccaacgatgcagaaatttaaaaaccttccaacccggctgccaccgggtccccaaacgctccccgtttgcagcctgacgggcggcgaccacccagattcggaatccgggcagcgagccgaggaaaacggggatttctggggctcggcccccctgtgaggtcaacagaggagggaccccccccggctctcggaaacgggaaacgggctcgggatcaaatggaagcgtttgcgagtgtggacacacacacggggacctgggttttgggggaacgtgcaacgcaccagtgcattttgcaaaaagcgatttttatttatttttttaattattattattattattattattttattattattattattttttgccttgaaacttgcagcgtccccaccggcgaaactcagcacgtcttaaatcggcggttttcttggcaggagcgagcgcacaggtctcatgggagccccttaaatatccatcttaggggatttttttttttttaatggaagaaaatgtgagaacgcggcgggcgggggatgctaacaaaacacagaccgtttttacgacgtatttttgcaaattaaccagaggcccctcgccggggcctgggcagcgtctggaaactgttttctttcttttttttttttttcctaaaaatctgattgcttctggttgcctcgtgccctcgcggggggaccggctatgaccacgtgaccccagatgccgccgggggtttttggttgaaatgaggacccggtttgtctccgggaggtttccgagcccgcgttttttcggggttcgattgtggacgcacggaaacgccgagcgactggagttaacgccccgcgcgccgcacgttgggaaactggtttctgtggattcggggcttaagcgaaggagggggtttcgtgagggcgacggggggtcgtgactctcggggttgcagaaacgatcagacaaacgggagcggggggcggtggtggagcgagccagacgtgtagggctggaatgcaggccttatcagggccttaggggccccggggcggctgaaacaaaatcctgaaaactgggtggtttgaatccaagggatccgtccatcctcccccgtcctggagcccagagcgtgaggtcgagggtcgcagggccgcgctccctccggaggctccaggggagggtccctcctgcctcttccggagtccggggctccagggtccctgggctggtggccgcctccctctcttctctgcctcggtcctcagggggccgtcttctccccgtgtcctcaggtggttgtcttttctttctttctttttgttttgaggaagattggccctgagctaacatctgctgccaatcctcctctttttttttttttttttttttttgctgaggaagactggccctgagctcacctccgtgcccatctgcctctactttatgtgtgggacgcctgccacagcatggctgagtaaaataaatgctcaggagtccgcgggattagataaataaatgaataagtaagtaggtaagaggagaaggctgtttctaagagcagaatttcaacggttgatgcagaagagatggagctggaagagcatcaatgagtgggtggaacccgatgacgaccgggatgctgatatgaccccaaagcgtcctgcccaacaagttgctcactaattgcaaagtggggacggtgaccccaccgtggaaggacacgttaccccaaaatccgattctgaattaatctcccgaatcgaatgaacaaacgggtggaaccaggaaaaaaacgtcagacgcgcccaaaccgacacgcaggtctcccaaataatggccccacactcttcaaaaatcgtccaggggcagaaagactcagaaaagcactgcggtttacgggggagaaaagcgaaatgcatcctcttagattagatctcaggcttcgggcgagaatcagtcataaacgagtgtggatgagacgacagatggtatcggggctcgatttcctgattttcataacggtgtcgggaacgcacagagaaggccgttttcttcagaaatacgcccagaagcaggtaaggggcggtttcgtttcgtgaggagtttccggcagcaaaatttggacaaaattggacatttcattttgggggggttgagactaatttcggggatgacgtagacgggacgtggagcacgttctagaaacacgagcaggagatgctccgtggttatgaaatcgggggggtcgcacagcattctgggaatcccaggagcggggctgggacgctgggggtcgtctgtctgttgtcggtttaatttgcacacccctggtggacaggacttaagagggtgtaggaagttttttctccgctatgtctccatttgtttctttatttccccagaaagtataaattttattggaaaagacccacttccttctaaattgaatctacctgatttatagtttggcccagttttctcatcaccagggacaaaaatggcttttgctgtttcctatcgatgggatcacgcgtcccgaggccactcgggggccttggaggacccgggtgaggtcaaaggggacttagtacgaaggacggaagacgttcctctcacgtccacacttgggacatcacacgttctatgtaggaaccgaggacaaaggcccaacatcaaatatacgtttccatcgcttttttttcttttttttttttttgacccattttgcccacttcccatccccggcctctggcagccacgagtctgttctctgtagctgcgagtttgttttttgggggttttttttaggttccacatataagtagatcccacggtgtttgtctttctctgcctggcttatctcactttgcataacgccctcgagggtccgtccacgtgggcgcaaatggcaggattcccttctttttcgtggctgaatgacattccgttgtgtggatatagaccacaccttctttgtccataaaaggatttcttccccttttcatgggtgagtaatactccattgtgtatatagactgcatcttctttatccataagaggctttccttctttttcatggttgaataatactccagtgtgtgtgtgtgagtgtttgtgtgcatcacgtgttctgtatccataagagtctttccttctttttcatgggtgaatactactccattatgtatatgtatatttatcacatcttctttacccatcttctttatccataagaggcttttcttctttttcatggctgagtaatattctatcatgtctatagaccacatcttctttatccataagaggctttccttctttttcgtgggtgaatactactccattatgtatatgtgtatttatcacatcttctttacccaacttctttatccataagaggatttccttctttttcatggctgagtaatattctattgtgtgtagagcccacaccttctttgtccataaaaggatttcttctctttttcatgagcagttaatactccgttgtgtatacagactgcatctcctttctccatgagaggctttccttctttttcatggcttaataatattctattctatatatatatatacatacatgtctatgtatacatagacaacatcttctttattgatgacaggattttgttctttttcacggctgaataatactccattgtgtgtatgtatacatataccacatcttcttcattcataagaggctttccttctttttcatggctgaataatactccactgtgtgtatggatagatacaccacttcttctgcacccctcagagtctttccttctttctcacggctgagtgacctgctattgtatggacagcccacctcttctctgtccagtcacccatccatgggcacttgggtagtttccacgtctcggatattgtaagtcaagcttacacaaacatgggttgcgggtatctcttcgagatgaagctctcgcttcctccagatgaacacccagcagcaggactgaaggaccctgtggtgtcttcctggtgacagcccagcatcgcctcccctcccagattctctccatcctcatcccccaaagtcctgatgacatggcccatcttcctctttttttttttttttttttttttttgctgaggaagattgttgctgagctaacatctatgcccatcttcctccttctatttttttttttttttggcttgaggaagattggccctgagctaacacgtgtgccagtcttcctctattttgcatgtgggacgctgccacagtgtggcttgatgtgcggtgtgtaggtctacacctgggatttgaaccccaggccactgaaggggagctcgcacacttaacccctacactaccaggccggccgggtcattgtttttctcagttactcacgaccatggatggaatgcatttaagccaaacctatgggtctaaatggccgtcttggcccagaaacaaggtccggggtctgtccctgtggtggccccaggaataggtcgtcacacccgtgtcccagcttcctgtgaattttctgcgtctacacggacaccaaccaccaacttaattgtcacaagagctctggtgccaactgtttcttttttctctttatttcaatggaaaaaaaatacacgcactggatggagagatgtttcaagggaccgattttcaatttaaatatgtcttagatgcagagggacgtcaggagggtgggttcgggaagaaaaactgaaggtccggggaaatgtccccatggttgccaactgagtccccctttcagaataagagctggacggctggtaggtaggatctggagagcaggattctgttcccgcccggcccggcttgctgggtccacctgcggtgtaacgaaggagccgagtggccatggggtgtggggggaccccatgttggcttttgagtttgcaccccctcataacatcatgtatgagttgtcagtcatcacaaaagtgaagtcccccagagagatggcctctctgccggggggaaaccggcgagggagctgactggggtcagcagccgcctcttcctcccccgtcggcgtccccgtgggcgtctcggcctccgccttggctggctgcacctccagggcctcctccaggaagcactcctgctccccgtcgtccgtcttgttcagcgaggccacgttctgcgtgtccttgatccactcctgtgggaagggacatggtgacacacgccctgaggaacccggtggggcgggcgctctcactctccggtcccacagaaggggatccgggtccccctgtccccaatatgccgtttgtcatacggggtattttgagctgaagggaatcaagaaacagcagtttggggcagagctttcctcatgggaatttgtctattccatgtcatttgtgcggttcattcacaggccccaggcactgcacttaagagggaaggatggagccccagacgctggaagaggcaggagggaccctaccctggagcctccagagggagtgcggccctgcgacccttgaccccagactctggactccaggacgggggagggtggacccctgggggttcaagcccccggtttgtgggggccccagaaaactgacatccgcccctgtcaaccctgacagataaacggccgggaacgtttgcaagaggaagttgccgggtggttgggaaccggcggaggggccgctgtcgagagcgcgacttcctggcgagatcagaagccgattagcccggaaaatccccggggggccccccgagtcatctggagatcggctgccttgagaccccgggacagcatctgggtgaccctgaaggacgacagggggccctggggggtgacccctcacctggaagttgcctcggtgagactcgaacagcccggggaaggtgaacttggggtcggggacgctgggcatcaggagcttcttgactctgcagtggacacggagaggcgggtcagacgggcaggttgactcccgacccctgggccgggcggtggactcgctcggggcccagacccctccgaggggccgagctgggctgcagatttcaaccgggtggaaccgggtcctcagtttcaaggtgggagcgttatgtattttatgatgtaaaataatgtgatgtgaaaatactatagaaaataaataaaaatattattatataaaataatacaatataacatataaagcagtcataaactaaaaataaaataatgcaatataacacagaaaataataagataataaaagtatgacgttcctaaagaaacatgtgcctatcctcctgtgaatccacctttggcccgtttaattcacaggccccagggaccaaacctaagagtcccgtgaagacggggcgagcgtgtctgtttgcagagtggtggcctcagtttccctaaggcctcgtggggggcatcaggctgaggcgctgaaggaggtgagagcggacgggacgggtggcggacggcgctcgaggacccgcgtggtccgtccatccgtccatcatcctcctcccgtcgcatcgccgttgccatgggaaccgcatccctggagacaaagatggcgcccaccgcaccgcgcatgcgcacctgcgcgcgccggtcaccgcgcccaagggcccgggcgcaggtaggttgaagtcgagatgggagcggccggggtgaaattgtagcaggaaaggttcacagacagaattactcagtataagatttttaaatcgagacctagtttaaaataaaatgaagtaaaatttataattaatatggtatttttaacatagcgaacgaagacaatatgtttaaaatagagaactatttgatacaaaatctttaaaatagaggactattttaaaaatcaaattaaatttaaaattaatacgggatttttaacatagagaaataattcaatgtgtttaaaatagcgaactatttaatacaatattttttaaatagagggctattttaaaatcaaattaaatttaaaattaatgtgggatttttaacatagagaaataattcaatgtgtttaaaatagagaacgatttaatacaatatttttaaacagctgttttaaaattaaagtaaatttaaagttgatacggtatttttaacagaaagaagtaatgctatatgtttaaaatggacaactatttaatgcaacatttttaaaataaaaaactattttcaaattagattaactttaatttaaaattaatgtggtatttttgacatacagaagtaatgcaatgtgtttaaaacagcaaactatttaacacaatatttttaaaatagagaactatttgaaaattaaactaaatttaaagttaatgccatattttgaacagagagaactaatagatatgtttaaaacagagaactatttaatagaacattttttaaatagagaactattttaaaatgaaattaaatttaaacctaatatggtatttttaacatagagaactaatgcattatgtttaaattaaagaactatttactacaatattttttaaatagctattttaaaattaaactaaatttaaggttaatgcggtatttttaacatagaggactaatgcaatatgtttaaattaactatttactaaaatattttttaaatagctattttaaaattaaactaaatttaaagtgaatacggtattttgaacagaaagaacgaatgctatatgtttaaagaactacttaataaaatatttttaaaatagctattttaaaattaaatttaaggttaacacggtatttttcacatagagaactaatgcaataggttcaaattaaaaaactatttaatgaaatattttttaaacagctattttaaaattaagctaaatttaaggttaatacggtacttttaacagaaagaactcatgctcatctttaaaatagagaactattttaaaagcgagtttaaagttaatacggtcccagcgggaatgactgtctacgcagcctgccgccccgagagagcatttcccgggaacctgcaggcgtctttggggtgattttccccccgcctgtgtcgtgacgccccgttggccccgtgagcctcgtgggggcgcgatgctgtgctgcactccgggacccgacagcgctcctgtgcccccaggtccgggtccgggcgtgttgggatccccgcgcccgcatccgggttagtgagggtgtgaggacgaggcccggggggcgtcctcacctgcgcagcttccacaaggacacgagcaggaggaccaccgtcaggaacgccaccgcgcccgagatcaacacgaagcgcgggaacagcctctgctcctggcacgaatctgcagcgacacaagcacggcgggagggtcccacggggcgccagcgcgacccacaccccacgaagcgggtttttcccttctgcgtgtcacggtctgcaaagctggactccgggggaagagcctggaaagccacacggcgtctgcgcacaggcgcacgcggtgtggacgcagcacacggaactctgatgatgatggataggtaggcaggcggatacatagattagatgatagatgatcgatagacgggggtcgacagccagccgggccctccggcccccgccctatctatccatcatccattccatctatgatctatcaatcatggatcaatcattcatctgtctatcgatccacctatccatccgtccatctgtccatccatccatccatccatcaatctatccatccatccatcaatctatccatccatccatctatctatccatccatccatccgtccatccatccatccatccatccatccatcaatcatccatccatccatctatccatccatccatcaatccatccatccatccatctatctatccatccatcaatctatccatccatccatccatccatccatccatccatcaatctatccatccatccatctatccatccatccatcaatctatccatccgtctatccatccatccatctatccatccatccatccatccatccatccatccatccatccatccatctatccatctatccatccatccatccctccatccatctatccatctatccacccacccatccatccatccatccatccatctatccatccatctatccatccatccatccatccatccatccatctatccatccatccgtctatccatccatctatccatccatccatccatccgtctatccatccatccatccatccatccatccatccatccatccatccatccatctatccatccatccgtctatccatccatctatccatccatccatccatccgtctatccatccatccatccatccatccatccatccatccatccatctatccatccatctatccatccatccatccatccatccatccatctatccatccatccgtctatccatccatctatccatccatccatccatccgtctatccatccatccatccatccatctatccatctatctatctatctgtccttctgtagataggtatagacacctggaagtccacacacgcaggtgtttagagacagacctccgtctacaccggtgaggctaagttggcgggtgggcctggctctcaccccgctgtgtgaacagaagtcgagaagaaaattccccggacaaggccggccgcctggagaggggaccccgcagggcgggctcttcgtctgccgtgtggacgaggccgccaggtcctcatgccccagggtccccaccctccccggaggacggggcgccggccctgccccgggacccgcgttacctcgccgccggcccctctgctggtgggccacctccgaccagtcgctggggtaggtgtcggggccgtaggccgcctccatggtcctcgctcgggcccggaagaagtagcatttgtcgggatccaagcccgggatcgacacgttgcagcttctgccctcctcagcctggaggacaagcagacccagccgtcagtgagtcgatcaacaatcttgaccttcacccctgggactcatgagaccccgcattcacgctctcatttgacctcctctctctaccctccaagcgacctccaagcgacctccaagcgaccgcggcacaaacggacggggcaacgcctctcccctcggaggagaaaagcatcctttacaacaaacaccccgacagatgctttcaaagaattccccggtgccgggtgctcccttcaaatgagccctgattgtcacaactataaatgtcccgcttgcttaatttcgagattttaggaaacacccaggcagacaggctgaaaaccaactgaaaaagcttgagaacctgccttattgtagctgcaatagaatcatcattaggaaacggatattttttatttccctccaagaggattcagacaacacgatgatttactggacccgctgcctctgatcactaaggactatttttgaaaaaaatgaatgaatgaatgcaaagtggtgcagccactgtggaaaacaatatggagaatacaaaaaaaattaaaaataaaaatagaatggactcagctatcccacgactgggtttttatccaaagaactggaaatcaataatttaaagagattcatgcatccctgtgttcatggcagcattattcacaatggtcaagacgtggaagcaacccaagtgccaatcaattgatgattggataaagaaaatggtgtatatatatatgaatgggacgatttcatcctttttcagggctgagtagtattccattgtacatatatacatatatatatatgtagttggtgaactccaggcggtctacacagaaagtccaatataaaaacacacccctgaaatgacacaatgttataagcccttatggcctcaataaactaattttcttcaaaagccaaaaaaattctaaaaaacgccttcgggtggctcttcactcttttactacacagacgacccagagtttattggacgactcctccaagccgactttttagactttccttgggcctttccagggaggggcagcctcatcctcggtttacacggcaggcctcgaaggattgggagacggctctgagccctggctcactgaccgccacaccattttaattgattccgtagaccgtgctcactgactcggagccagggagtgtccccacgtatctaaaggccgtgaaagaaaagcgggcagtgtgtgcagggcgtcatcgccccccgggaactttgcccaatggtgagttttacacgtcgactttgtcaaattcttccggcatctcctctgctggatgccagtctggacggtggctgtgaagctgacaggtggacgcgattcgcttttatgacccgttggctttgagtcgctccgccacgagggtgggcctcgcctaatcagttgaaggcgccgaaagaaccgaccggagcttcccagaggagacggaattaggaattctggtgacaggattcgaacctgagtgtccagcctggggacccgagaccggccgcgtcctacgaccccatgagcgaccccaaaactagcagcttgaggatgccgccggccccactcacctgccactcagggtcgaacgtgctcttgtactggatttcgtagaggaggctcttgtggggcagctcggagcaggtcacggtcacggcctcctcatgccaccggaaggtcaagtctccgggggggtcaggcttcactgaggagggggtcacagagcacaaggtcatgaacgcccccctgtctccaaaatgagagcgcccctttcccccacattcgctattttaacatcttacgagatttggggtggatggggcctgattttacatttaggccccgtgggtgtcgggatggaactttctagaaggccagcgccttccgggctggggtaggaatggcgggcttctgggcacttacggtaggagctgatccattgactcttggccagaagaggacgcgttccgcgccggatggagaagctcaggattccgtccccttcggcctgcaggacgcagccgaccgtgcggccgtcttcgagaatatactcggggcaggagctgtcgccctcgttaggtcggaagctgtgggtaaaaaagagaaacattcaggggccggccaggtggctcaatggtgaagtgtgcacgttccacttccgaggtcccggggttcaccggttcggatcccgggtgtggacatggcacagcttggcacaccatgctgtggtaggcgtcccacatataaagtagaggaagacgggcatggatgtgagctcagggccagtcttcctcagaaaaaaaaaaaaaaaaaagaggaggattggcggcagttagctcagggccaatcttcctcagcagaaaaaaaaaaaaagagagagagagagacaattcagccatggagcgtctttgaaaataatatcttgactcgtccactggacattcttatgctccacgcctcggtaatggattcagagtgggtacctttttcacccggttcaaaggttcccccctcacaactacagcgagacgtgtgcaaacagccaagacgccatctctcgagtggttgaacccctcgaacagcttccatagcaggtggaattgagagcctccaaaacgcacgtacaggtattaatcctggtccctgtgaacggggtcttattggaaatggggtctttgcagctgtgatgaagggaaggatggagaggagggcttcctggaggaggtggccctgaaccaaggatggacaggagggcttcctggaggaggcggccctgaaccaaggatggagaggagggcttcctagaggaggcggccctgaatcaaggatggagaggagggcgtcctggaggaggcagccctgaatcaaggatggagaggaggtcttcctggaggaggcggccctgaatcaaggatggagaggagggcttcctggaggaggcggccctgaatcaaggatggagaggagggcttcctggaggaggcagctctgaatcaaggatggagaggagggcttcctggaggaggcggccctgaatcaaggatggagaggagggcttcctggaggaggcggccctgaatccaaggacagcgtcctcatcagagacagaagaggagacgcagacgcagaggagcagccccgtgaggacggaggcagagacgggagggaggcggccaccagcccagggaccctggagccccggacgctggaagaggcaggagggaccctcccctggagcctccggagggagcgcggccctgtgacccttgaccccagactctgggctccaggacgggggagggtggattctgtgtttttaggctgcccggcctgtggtcctttgttatggtggccccaggacgcttgcatggccgcagtttgatctgtagagtaatgaggccctgatttgagggagtaatttaatggggatgcacagtcgagtttccgtcttctgtggtctttctggtttatctcgtgtgcgatcaaccaaccacccatcccccacctcccgttcacagaaccgagatgaaactcactggaaaaacccttcttcccacgtttggactcatgactctgagggtttaaggcgacactgacaagcccaaaagaggcaaacgggtcacccctggtgacctgggttcaaaagattgacaccgagaccttgcacacgggccccgggggtgagaaaggacttcgcgaatatcgggccgagaatctaggcggtttcgagcatgactcagtcatcctcaggtgacaagatttggggttgcggtgaggactgaggctggaacacaccccacctgttcacactcgcgcattctgattattcagatccgccctttccagccccacctggggggccgacgtctcagaagaagaagggtgtgaccacagggccttggtgtcgcccaccagagggtgctcacctgtaggagaaagtcaggttgaccccggggctcccgctgctgttccacgtcacctgcacggttttgaagttgaagttgatgatctgaacctgtaatggtccttctgggtcaaaaaagagaaatcgaggccaaactgaggcaacgctgagcagagttgggaatctgtaaaatgacgtgggaacgggatggggcttcaaagggacacataaaagcaagattttctcaaaaatcgtgtcaatattcatgtcagccagaactacgggttccttcgggtcaatgaccatcagagttgcgatcaacaacacgcccatagctgcctttcttcaagcgtttgcaagaggtcgtgaccagcggtgggtgcgaggagcagagagtgagtgtcgaccgtgcgtctgaggacatcacgatcgtgggcgccggacaccgtcccccgtgcaccaaagtcactgtttcactcaacaaaccgcacacgacgactggaggaaaagctccaggaaccaggagtccttcgggctttgacttgaaagttatcgagggtttagaagacgggatttgtgcagagttctgggttcgtcgttctcgaagcagtgagcaggggtgttcgaggttggggcaagtaaggggtgatgtgggggcgaaggagacgtggggttccagctgtcagagagggagctgcaggtttggaaatagggacggtcagagcgaactctgtgctgggttagaagtggaaggatgaggatggagagaggagagatacatagagagacagagagatagtggaggatgcatggatggatggatacgtacgtagaggcatgatagagagatggggataacagatgactgatggacggatggatggacaatagaagttcacggatggacagatggtggatagataggttattaatggataaataggtgattgatggatggattcatggatagatggatggatggatagatggatggatagatggatggatggatggtggatggatggatggatggatggatggatagatggatggatggatggatg

The invention claimed is:

1. A method for breeding a horse, said method comprising the steps,
(i) extracting DNA from a biological sample obtained from said horse,
(ii) determining in said DNA two copies SEQ ID NO: 18, and
(iii) breeding said horse.

2. The method according to claim 1, comprising the amplification of a nucleic acid segment by means of the polymerase chain reaction (PCR).

3. The method according to claim 1, comprising hybridizing a primer or primer pair under stringent conditions to the sequence SEQ ID NO: 18.

* * * * *